United States Patent 7,745,391 (HUMAN THROMBOSPONDIN POLYPEPTIDE) - sequence listing, part 12

SEQ ID NO: 28503 - DNA, 243 bp, Homo sapiens
tgctacttattagctcattggccctgaacaaatctcatgtttcagagccctcagttgtgaaatggagttaataatattactgcttcatggggttgttgtctgaacttagaacaaataatagctattatttgtaaatggttattttatgtagataacccaagagaagtctgggtgttgtggctcacacctgtaatcgcttttggaggcaaggcagcaggactgcttgaggccaggagttcgaga

SEQ ID NO: 28504 - DNA, 314 bp, Homo sapiens
aagagattgaaataagagctcactaaccagagacgacccattatggtttaaatttctttgtatatgtgcctaccttttcctgtgtgtgtatatttaatacacagcttgagtattccttctctgaaatccttgggaccagaagcattttggatttcaggcttgttcagactttggaatatttgcattatacttactgtctgagcatccctaattggaagatctgactccatagcacatttcttttgaatgtcatgctggtgctcagaaagtttcagattttagagaatttcagatttttggattagggatgttca

SEQ ID NO: 28505 - DNA, 418 bp, Homo sapiens
gagatttagtaccaggtgggttcaggtcctgagcaaaagccccatctttgaattcagaatgctgaccccagggccgatcgtgtagagcctatggtgtatcttaatcgaaacccgtggcccaaacatctcagccaggaacctgggactttaggtgtcacttaatctcttcacacctgttaactacacctatctgcataggaggctccccacatcagtccaggcaacttttttctttgcctggggccatttcttctaaatggaaggagaaaagtctgagcattagaaattgtggcattaatgtctgcaagggctaatggagtgaaaagaatacattattctccttttcttcttagaaaaaaatttcaattgtggatgtaatagaaataccattaaaataatatttctgattgcattgctt

SEQ ID NO: 28506 - DNA, 385 bp, Homo sapiens
gtctcaatgaaattccattgcaccgagtggcatgttaaatgagagctattacaatgtagaaggcaaggcaacaaatttctcctggcttgatcaagactttcctggttttaaaaatgaatatccagcatcctgggaacccccctgtcctgggaaaagcaagagagatggtcattctcatgacagatattgtatcagtggcatggaaacaagtacaatgagagtatgtacaggtgacggagccattctttatgcctcaatagtattgaaagaggcttaacttagtgatacttgagttgagcattgtgcaaactgtaataaacacagtagacaaggacagtaagaggaggccaaagagagaggcaatgtaaacagtcatgaaaaaaaa

SEQ ID NO: 28507 - DNA, 644 bp, Homo sapiens
aaaagtgatagtcacatacttcacatcatcttccttccaaaagtagctctccccattatgcaatacaatttgggtcaatgctctgggccccatttccttgagtttagaaaactattataatttccttataaacatccaaatattctttgcattcataaattgactactactttatctcaaactgaattttctattatcactataatttattgtgtttataaaacatagagtggaaagagctaagcaaaaaggtttccttttcattcttgagatgggcgcttctcaactgggaaggatttaaataacacaaccggaaacctctcatttctaagtcgaattaatagctgaggatggctgaaaaagattatacatatccagaagataaaaagtaaaatgaggccgggcgcggtggctcacacctgtaatcccagcactttgggaggctgaggcaggagaattgcttgaacccgggaagtggaggttgcagtgagccgagatcacaccattgcactccagcctgggcgacaagagcgaaactccctctcaaaaacataaataaataaataaataaataaaaacagatttaggattaacactgtaaccttattgagatggtagaatggcaatataaattaaaacaactc

SEQ ID NO: 28508 - DNA, 304 bp, Homo sapiens
ggacatttaggccatatctagccagatgagaattgaatatgtcaatggttggaacttgaatgtcttggcactgagggccaaagtgctctagtgtcctaggtaaacttgaaaagcagtctaggacataaggactacaattcataggcaactgctagtgctgggcttggctcagagtgagtggattagagtggcatgtgacctagggagacaatagcaaaggcagctaagggagttttcccattaccactcctgcaaccccaggcagtgtatcccactgcaatgaaagtgactccttacttctgct

SEQ ID NO: 28509 - DNA, 401 bp, Homo sapiens
ttgggaacattctaaatcttctcttctagctatttttaaatatgcagtaaattcttattaactatagtcattctactgcgctgtcaaacactagaacttattccacctaactgtatttttgcaccaagctttcttcattcctccctccccactagcctctgatatccaccattctactcactaccttcaagatattaatttccttagctttcacatatgatatttgtcttgctttgcctgacttatttcacttaacagaatgtcctccagtttcatccatgtagttgcaagtgacatacatttattcttatcctgtaaagatgactgagaaaagcatgatttgcaattacaaagacttgtggtaggcagatttctaagatagcctcaaggtttcccaatcc

SEQ ID NO: 28510 - DNA, 722 bp, Homo sapiens
tagaaagcaactggtaaaattctcactgattagatatctggatgagaaaaagttccccacaataaatggaaatttaaaaacctgtgctggctgggcatggtggctcatgcctgtaatcccagagctttgagaggccaggatgggggaatcacttgaggccaggaattccagaccagcctgggcagcatagcaagacccaatctttacaaaatctcagagctctgaaatgccaaagtgggagtatagcttgaggcaaggaattcaagaccagcctgggcaacacaacaagaccccgtccttacaaaatataaaaataaaaaaattaactggtcttggtggtgcacctatagtctcagctacttggaaggctgaggcaggaggattgcttgagcccaggagttcaaggctgtagacttctatgactgagccactgcactccagcctggtgttagagcaagactctgtctctgaaaacaaatctgtgctgtgcatgggtattgaatccaaattttacactatttgcatagtacaggaatctcaaatgaatatattaatgtagatgtcataattacttcaagcaagtaaaactactggagtttccagaagaatcaaatgtaaaacttgtctaaaatgatactaccacatcttaaagtacacaggggtgccacagggaaaaaatactctagctgaaaataagtttacaatgaaaaagaacaaaccaa

SEQ ID NO: 28511 - DNA, 164 bp, Homo sapiens
ttaaattcttactagtcatttaaataaaattagttctttaaaataatacaagcactaagacctacagcagaaataaactagaaacagcatgattacaggaacatccaagcatcatttggcaaactgggtttcagggaagcaaagccttttcagtagtaactaat

SEQ ID NO: 28512 - DNA, 636 bp, Homo sapiens
ttgtagaatttcagtgagcatagtcctgggttaacctgacaacagtcctactgtttattgatgcttataggtgagcctatttctctttctagctttcttccacttaatttactttcttttggaattcttgaatttaataataataatattgatgttattagtcatcactataactttttattgagtatgtattttatgtcagacacagtgtggctaagtgctttacatacattatctcatctaatccttagaaaaaaccctggtgtattagtcttaatttaaaagatgtactttggaaaggttagtagtttacccaagattatgcagctagttaaaagtggtgctggggctgggcttggtggctcacacctgtaatcgcagtgctttgggagtctgaggcaggaggatcgcttgacaccaggagtttaagactaacctgggaaacatagcaagaccccatctttacaaaaaataaaaaaattagccaggagtgggggtgcacacctgtggtcccagctacttgggaggctgaggcaggaggattgcttgagccccagaggttgaggctgcagtgagccatgattatgccactgcacatctgtctgggtgacagagcaagatcctgtctccaaaaaa

SEQ ID NO: 28513 - DNA, 377 bp, Homo sapiens
aaggcctagatctctgaaagtatcttttctaaaaatgcagtgactctgagaggtgggaacctgagttctctccgcagtcttcaaggcattcttctggagggctgagatgttactaagtcaaggggtctgaaatgctgacaaacacagtgaacaaacgtggctttttcacagtgagggaggactatgctgggggccagaagcagacgttcgctactttgtctcacatttacaattctcggatttgcttcaaaacattgcccgaagagtgcctgggctgcagatgtagacaagattaaccatgaattgataaggtagaaactagatgataggcacacaagggttcccttatgaaattgttagaaaagttccatagcaaa

SEQ ID NO: 28514 - DNA, 380 bp, Homo sapiens
cctgtatatgtgtgtatgtggcagggttcattctgacacttgctttttttcatttttcattttcctacctgttagtgaagtagaaggcaagaaaaataagtagtaatgtgtccggaatttattccttctggtaggttcttggtctcgctggcttcaagagtgaagccacagaccctcgtggtgagtgttacagctcttaaaaatggtgtgtctggagtttgttccttcagatgttcagatgtgcccagagtttcttccctcctgtgggtttgtggtctcactcacttctggagtagtgaagccacagacctttgcagtgggtgttacagctcttaaaggtggcacgtctgaagttgtttgttcttcccagtgggttcata

SEQ ID NO: 28515 - DNA, 2328 bp, Homo sapiens
  misc_feature (504)..(504): n is a, c, g, or t
ccaggaatggacacctgcctcagactgggccagtcacattctctactgaaaatctgaaattccaacaaaaggcaacgagttagttgctaccaatatttagcaactacaatgaatgattcgtgtctatgtaattaaattttttaagtgagtaaatttaggggctggtaaaacccaggaagtatgcagtacgtctattcttacattggattaaaaagcaacaaagtgcaaaatggtaaatactcattacctctctcagcccatccccaggcctctcctcctatgccttcccatgagtcagtcattagagggttaatgtttggcacaatggtgactgtacccatcagctcatctgcctcagttctgattaactggtaattgtgctactccagtttttcaacattttgaatattacccccgcctgcttccaaatagtactagaaagtcttgcttcaccctcctctgttgtggaatgatgcatgccaggatgagctcaggttaagacantaattagatctgagattcaactttaccatccacagtcactgaatcacttagaggtggggttagtattaaccccagagcactgaagagacttgtggcttcacttaggccatgagcacacaatctttcacatctgtcctctccagtctacactgcaccacctggtacctggcacagactcttgtcccatctgagtgctcctcgctccagacttttcaatgcattttccatttggctcccaatttaaccatcctgagtgcctcactgattaacctagatggtgctgtggcggaagaaggactccaagaagactggaccttgttatccagtacacctcggcttagattcttgccttgccgctgcactagctgtgcagcctcagacaaattgtgtaattgtaaaaccaggatttcctcttatttaaattggagagattatcatcatcatcacatcatccctttgggcccggatctcctgtaatctgcatgaaatttactgcatattgtttatctgctctgccagagtaaggatattgttatattcatttttgcatcagtgcctcacctgattcttggttaacaataggtctttggtaaataaaattccccccaagttgaatggaatcaagttccaaacactaaagtaagtttcaaatatccaaatgttgaaaatgcaattgatccagatgttttcatatcagtggattatatgccgaattgatttcctccttagaggaaagtcagtagccctgaaactttctacacattcccaacaatttctgtaaaactttcaatgatcttattctctataactagatatgtgggccaagaatcccaacacgtttgccccttaactttgaagctggcaatatgaattaccagggtgacccctcccagtagagcacatgatcagccacagctgtgcatgttttttagtatgactgcactaggatagggctccaagccactgggtggagcaatgtgctctggggagaaagctcatgacatttcccctatgatttcacaaaagaaaaaatctttttcttatgagttgtttctgctcaacgtcaataggaaaggtcatagcttagcgtgtttacatacagatgcatgcatgaatatgtagaatatcagccactcctacggtgtgagagaatttaaattgcactggtcctaagagtgaaggaaagcaggcgtagttgcctactcaacctccactttattcttttccctttataacaatcctaatttcatttgagatgacaatgtatacagctagaagacaatttctcagcctcccttggagagctaggttccagccaatgagatgtaaacagaaatgtatgcaatgttcaagtaggctgcttaaaagaagttgactccacttgaaaggtgtgcttggtttggcctgccttctcccttcctctggttgaatgtcatcttgatgactggagctccaggagccatcctggaatttctgaccttgagggtggaagccacaggctaatatgatagaaggatgaggaagaggctgagtaccagatggctgagaagccactataccagccctagtttcgagtttacactgcttctgtgaaagaaaagtcaatcacaataaaaccttttatcttgtttaaaccaccttaaaaagtcagttttcttttatatgcagcctactaatcctatccaaacaaggcttgaataaggtttactacagctcttttttgttgtaatagcagaaaaattggtaataaatgcccatcaataggaaaataaactattaatttaacaataccaaataaaactgtgcagcagtataaagaatgaa

SEQ ID NO: 28516 - DNA, 233 bp, Homo sapiens
ggtttagggtaaggactgccaagtattacactggcacaataattccagccttctgaaatcaggactagaaaattttcctccataccacactggtgtttcctttgacagcaaccactacctactgaataatgcctaagtccttagcctgctactcaaggccttccaatagtattttccactgttccctatatgggctttaagctttgtctataaagactatgttcttcagttac

SEQ ID NO: 28517 - DNA, 653 bp, Homo sapiens
atgaactggcagagagatggttattagaaaataaaatgcacttagagtcccccatgaatcatttatgggagacaccatgcttagcaaagactatgaaaatatggctgttaagggcaactcaggcactatttctggatgactttcaagcatgaccactagctacaggactgggcctggacacattagaagaatttaggccttcaggatgaaaaggaaaatgtgtgggcagagactgagtccaaggcagtggccttcacaagtcaccctgtgatggtgtccatactgcgaggcatccctcacccgagaaagcaatgttttctgcacgggatgactctggttacatttgcttgttcccgccatgaataaaaggaagagaggtcagctgaagaggcaattaattcaacacaactgagtctacgactaaaggaaaatggacgagcttccccacaggcagtaggagtgcccaccccaggggtccggtttatcaaggaatttcaaagcatcccctgccacgtgcttctgactcctccactacctcgctttggaataagtggttaaaaaagagaaacctctgtttattggactgacggagcaactggacttgttgaggttgcattgctcagggtggctccaggcaagcagacagctgagag

SEQ ID NO: 28518 - DNA, 361 bp, Homo sapiens
gttctgcaggaagtttttgacaaaaactggcaagggtctgaggaaatatacaagagatggagatccccctccccagaggaaatagtagtcacttacagagaaattgtaagacctccttttaaataaaatattaatgaattttcaagggaaatcccttttggaatctggcaaggtcacataacattaaaagcaggtggaaatgaggacacagaattgttcagagaagtagctaaaacagaagcttgagaattgcctatctctacatttggatatccagaaaagcttttgaaaagtaacataaggccaggcacagtggctcacccctgtaatcccagctcttttggaggctgaggcggggatc

SEQ ID NO: 28519 - DNA, 288 bp, Homo sapiens
tctaaggccaacagtgacctgaaattattgactggctggccgtgctaatcaactggagaaaatggttccgaggtcaccaacatcagacaaattcattttaggacctatgtatgtgcttagaaagacagaagtgcttttgtaaaggatactatttcagaaaaacataatcatagtaacaactaatgacgctataaaatgctgatgtgttgaatgctactttagaaaaacatgttcaaatctaggaaaaaatttgatagaaaactatctatctatcggcagggtctcatt

SEQ ID NO: 28520 - DNA, 2681 bp, Homo sapiens
  misc_feature (598)..(598): n is a, c, g, or t
  misc_feature (615)..(615): n is a, c, g, or t
  misc_feature (693)..(693): n is a, c, g, or t
tactgccatttaaaaataggtttttaaaatttagctaagtcttaagtaatttgccgttgctaataattttatctccttgagtcggttgttggggagagatgttatattcaataatttttagttattttgtaatgcagagtgtttattcatttcacagttctgcaatggatgtagtattttgggattgccctgtccagaaaattttcagctacacacctttaaaggaaaatgtttctatctcagatgaaacatgtaatttgggatggttcttcctttgtcacttaaaggaagagataggaaaagtctcttacccactttaaacatgagggtaaaggtttaggtcaaacttactggctttgtcattcaagcatatctgaatcctcacttttttctctttgctttttagggtcagaactgagatattaccaagaaaaggcacaatgccataatattatggtgttatggtattttgacttaaaggggaaaaggtacttaattttggtgggatgttgattgtaccttgttaaaaagactctcattttctcatatgttttctcctaataagatggaatatggagtatactgtaataatataagngttcattataagctatntggattaagaactattgcagagttgtaagcttgttatcaaattaatgcaagacatttaaactatttttttgcaaaacnatttatttttaaaacaacttaaagtatatctagggtgagttaaaagtccctgtgcatctatattagatggcaggttttgtcacagagtcactgtgtattaataataaatgttgaaatggcttctccgtgtctccagaagcatttacatgtcctccttgtgagatcatggtgcacagaggtctttggactgccctgaacccgtcttatgtggacataacctattcccttcgttttctcatcatgccatgtgtttaagatctacccgcttagtgtcaagattattgagattttcatctaaatgtttttaaaattgtattttgtgttttagtggaggacagtcttgatactgttctaattcagaaagccaaattttgatgcgcttttgtatattcataatatatactttaatatgccctattctaatctagtttgaaattgttagattctgatagtataatgataaaatcaaactatttgccaaaaagttaaatttacaagcagaaagatgttttgcgatattttctacttttgtgtagaaagataaccatttggggtaggcagcacaacagaatgtgaaagattggctttatatgatactaacacagtccagttaaaagtggaaacagggaaaagagagagagaaaactcatcatttagtttggtctagacacaatttggttaaattttaggattctattggcagttaacatagatgacatggacacagcctatgagtgctttttaaatacgtgcttctaaaaatctgagctcaaagcaagaaaaagaaaacaggaaagctgtatccatttgccataatagatgaatcagaattgttttctattaaatatttcatcacgaaatatgatggaggccagaagctatttttaggcttactataacactattatgcatttttataaataagaagaaggctgtagaaagtacttgaaaaatatctaattctctttctgtctaaggaaaactctttctacttggtgcaataatctgaaaatttagaaggtcaaaatatgtcacaggaaatgatcatagacctaaaaatagtttttaaggaaaccagctacacggggcaaccaaccatcttgctgttgaagaaaacagttccaaaaggctaaatcattggcataaaggaaacaaaacccaaagtatgcgttgtaattcttgagccagtattactgaaacaggataaaagttataaaatctaacataggttaatgcaatgtctctgctagtgctacaagtctaaaatatctttgtaacaatgctttcagaaatgccagttttaattacatttcacattgtatatgagagatactgctttatgaatgaatcggaataatacattttcatttaaatcttaattgcttttcattaaatgcgaagtcttaatttcaaaatgaaatcacactaccagcaatagacagttttcttgaaaactctaataaggaacaatagccagttccgtaaataactttaaaattctaaaagtgttggtacactagcaatcacaaatatggtttcttttaatacttttttaatcctgtaaagaagggtttttataaacattctttttattaatcagtcataacatggcgaagtgtgtagttgctgtttctgaaaagtgatccaaactctacatccagagattatgaaaaattcttatagaattttgtaacaagtatttacatgttgggtgaaagaaatttcatagtcgttggagtgccatgaaattaatacttgcaattcagattgcggtagtttacactttttctgtatgtttcaaatcaggtgtgtaccatttgtactgagaacaccacagaatgaattatccaaagtccattgattttaatacgtgttttggtttgtaaacaaattatagtaatttcttgcacatttttggaaattaattgtataagaatttatgtatctgcttctagatacagtgtgtaaataaaaaatttcgttcacaa

SEQ ID NO: 28521 - DNA, 450 bp, Homo sapiens
ccagtccaggctgtgaatgttgggcagttgctggccgtaaatgccgaggaggacgcctggttacgggcacaggtcatctcaacagaagagaacaaaataaaggtatgctatgttgactatggttttagtgaaaatgttgaaaaaagcaaagcatacaaattaaacccgaagttttgttcactctcatttcaagctacaaaatgtaagcttgcaggcttggaagtcctaagcgatgaccctgatctagtgaaggtggttgaatctttaacttgtggaaagatctttgcagtggaaatacttgacaaagctgacattccacttgttgttctgtacgatacctcaggagaagatgatatcaatatcaatgccacctgcttgaaggctatatgtgacaagtcactagaggttcacctgcaggtaccactgtgatcactgttgttgcttgttaca

SEQ ID NO: 28522 - DNA, 3454 bp, Homo sapiens
ccagtccaggctgtgaatgttgggcagttgctggccgtaaatgccgaggaggacgcctggttacgggcacaggtcatctcaacagaagagaacaaaataaaggtatgctatgttgactatggttttagtgaaaatgttgaaaaaagcaaagcatacaaattaaacccgaagttttgttcactctcatttcaagctacaaaatgtaagcttgcaggcttggaagtcctaagcgatgaccctgatctagtgaaggtggttgaatctttaacttgtggaaagatctttgcagtggaaatacttgacaaagctgacattccacttgttgttctgtacgatacctcaggagaagatgatatcaatatcaatgccacctgcttgaaggctatatgtgacaagtcactagaggttcacctgcaggttgacgccatgtacacaaatgtcaaagtaactaatatttgctctgatgggacactctactgccaggtgccttgtaagggtctgaacaagctcagtgaccttctacgtaagatagaggactacttccattgcaagcacatgacctctgagtgctttgtttcattacccttctgtgggaaaatctgcctcttccattgcaaaggaaaatggttacgagtagagatcacaaatgttcacagcagccgggctcttgatgttcagttcctggactctggcactgtgacatctgtaaaagtgtcagagctcagggaaattccacctcggtttctacaagaaatgattgcaataccacctcaggccattaagtgctgtttagcagatcttccacaatctattggcatgtggacaccagatgcagtgctgtggttaagagattctgttttgaattgctcggactgtagcattaaggttacaaaagtggatgaaaccagagggatcgcacatgtttatttatttacccctaagaacttccctgaccctcatcgcagtattaatcgccagattacaaatgcagacttgtggaagcatcagaaggatgtgtttttgagtgccatatccagtggagctgactctcccaacagcaaaaatggcaacatgcccatgtcgggcaacactggagagaatttcagaaagaacctcacagatgtcatcaaaaagtccatggtggaccatacgagcgctttctccacagaggaactgccacctcctgtccacttatcaaagccaggggaacacatggatgtgtatgtgcctgtggcctgtcacccaggctacttcgtcatccagccttggcaggagatacataagttggaagttctgatggaagagatgattctatattacagcgtgtctgaagagcgccacatagcagtggagaaagaccaagtgtatgctgcaaaagtggaaaataagtggcacagggtgcttttaaaaggaatcctgaccaatggactggtatctgtgtatgagctggattatggcaaacacgaattagtcaacataagaaaagtacagcccctagtggacatgttccgaaagctgcccttccaagcagtcacagctcaacttgcaggagtgaagtgcaaccagtggtctgaggaggcttctatggtgtttcgaaatcatgtggagaagaaacctctggtggcactggtgcagacagtcattgaaaatgctaacccttgggaccggaaagtagtggtctacttagtggacacatcgttgccagacaccgatacctggattcatgattttatgtcagagtatctgatagagctttcaaaagttaattaatgactgcctctgaaaccttgacaactaattcagattttttagcaataacaaaatgtagtaggcttaaaaaaaatcttaactctgctacatggctctgactgctgtgggggattgaaaagaatatgcttatgtttgatgaaagatatttaacaagttttgttttaacagagttgacttttcaaagaaaattgtacttgaattattactataatattagaataaaaatgtttatcaatataaaaaaaaaaaaaaaaaaactcgagactagttctctcgcgagagggaggcgccatcactcggcctgtaccacccacaacgaggacctaggttgtccttagcatgaggacatcaacctctcaagaacagaggtcagtgccttcctgcgccaaggtccctgcgtttccacaagtccttggtcaggtacctggtcctaacaggctgccatggaacaaatcagagcctcactgactcaccattctgctcctaatgaggctacaagaaaaaaaaccagaggagagaaagcagagcttattacaatcaggaaagagcatgaggttctggcagctgcacttggtctcagctaaagaaggcaatgacctcatacgatagcatgggaaacaaaaatcaagcagacgaaccacattgcaggtgatagatacgcgacgtgcacctggtggggcagcctggggaagtgaggtgatgtgccctactttaaaacagatcgaccagctgggctcctgggattcagatatgaaccagcagtcctctactaaaagtttctttctgcagcgatgggaaaattcagccattgctctgtttcttccaacaagtgaagtccattacagcctaatgtctcaatcttttagttctagctctaaggcctcaggttcaatggctgctgtccctttaaacccttcatttgtcctaaatgtttcaaatagctgcccccaaatgcacgtgtgttaaagatggaagctctaggtcggggtctgagagacagcttgacacttggtagaatacatagactactgtgtctcaaagtgtgttccatggaacattaactccagacctgttcctggagaagagaaaatcctttgtatctgagggggaaacattaccataaccttcctttggggaattcatgtgtgtattagcatattaaaggctctcataaggcctgcaatgcagaaatctatttaagttttatctgtttaacccaatgtttcccttaattccagaacattttctttgttcataacacctgttaacacctcctgaaagtgttcacgtagtagacttatctgagaaaagcaatttttgagccgttaaagcttctagattggacaaactaggcaattaatgatactagatcaattcagaatgcaatttgagcctcttccccctgggaaacaaagtgaaaagagtggatctcatggaattaggggagaagtagacccagaattcatggggggtgggtggctgtgaacaggacctgcagaagaggctcggctgtgaatatttccaaggccccttgacctgtgagattctgtagtgaacggttccagctttggccagcttaacaatgtgctgggccccaaggtcttgagagcattgccttttcttccattgaaataagttcgcttgtttgggaccattcaaaggatcaaaataaaatttacttacc

SEQ ID NO: 28523 - DNA, 2012 bp, Homo sapiens
ccagtccaggctgtgaatgttgggcagttgctggccgtaaatgccgaggaggacgcctggttacgggcacaggtcatctcaacagaagagaacaaaataaaggtatgctatgttgactatggttttagtgaaaatgttgaaaaaagcaaagcatacaaattaaacccgaagttttgttcactctcatttcaagctacaaaatgtaagcttgcaggcttggaagtcctaagcgatgaccctgatctagtgaaggtggttgaatctttaacttgtggaaagatctttgcagtggaaatacttgacaaagctgacattccacttgttgttctgtacgatacctcaggagaagatgatatcaatatcaatgccacctgcttgaaggctatatgtgacaagtcactagaggttcacctgcaggttgacgccatgtacacaaatgtcaaagtaactaatatttgctctgatgggacactctactgccaggtgccttgtaagggtctgaacaagctcagtgaccttctacgtaagatagaggactacttccattgcaagcacatgacctctgagtgctttgtttcattacccttctgtgggaaaatctgcctcttccattgcaaaggaaaatggttacgagtagagatcacaaatgttcacagcagccgggctcttgatgttcagttcctggactctggcactgtgacatctgtaaaagtgtcagagctcagggaaattccacctcggtttctacaagaaatgattgcaataccacctcaggccattaagtgctgtttagcagatcttccacaatctattggcatgtggacaccagatgcagtgctgtggttaagagattctgttttgaattgctcggactgtagcattaaggttacaaaagtggatgaaaccagagggatcgcacatgtttatttatttacccctaagaacttccctgaccctcatcgcagtattaatcgccagattacaaatgcagacttgtggaagcatcagaaggatgtgtttttgagtgccatatccagtggagctgactctcccaacagcaaaaatggcaacatgcccatgtcgggcaacactggagagaatttcagaaagaacctcacagatgtcatcaaaaagtccatggtggaccatacgagcgctttctccacagaggaactgccacctcctgtccacttatcaaagccaggggaacacatggatgtgtatgtgcctgtggcctgtcacccaggctacttcgtcatccagccttggcaggagatacataagttggaagttctgatggaagagatgattctatattacagcgtgtctgaagagcgccacatagcagtggagaaagaccaagtgtatgctgcaaaagtggaaaataagtggcacagggtgcttttaaaaggaatcctgaccaatggactggtatctgtgtatgagctggattatggcaaacacgaattagtcaacataagaaaagtacagcccctagtggacatgttccgaaagctgcccttccaagcagtcacagctcaacttgcaggagtgaagtgcaaccagtggtctgaggaggcttctatggtgtttcgaaatcatgtggagaagaaacctctggtggcactggtgcagacagtcattgaaaatgctaacccttgggaccggaaagtagtggtctacttagtggacacatcgttgccagacaccgatacctggattcatgattttatgtcagagtatctgatagagctttcaaaagttaattaatgactgcctctgaaaccttgacaactaattcagattttttagcaataacaaaatgtagtaggcttaaaaaaaatcttaactctgctacatggctctgactgctgtgggggattgaaaagaatatgcttatgtttgatgaaagatatttaacaagttttgttttaacagagttgacttttcaaagaaaattgtacttgaattattactataatattagaataaaaatgtttatcaatataaaa

SEQ ID NO: 28524 - DNA, 338 bp, Homo sapiens
gggacagttattgagaataatcttgggtcggtgaaagatgtgatgtcgaaatggtgtttagtgggaggacacagatgtatccaaatcctaaactagaccagctgtgagacacaagttgggttaaacggagaagctgatagatttttattttgatgggggtacagtggggagagagggcagccagtggcgggacacaggatgctgagcactgtgcttgcctgggctcacccctcctcccaggtaggtctccagagaggtggatgaccaagaagatgctatgatatggaggctcttcctaggccaggtaacatcgagtgcccagagtgaaagagggccag

SEQ ID NO: 28525 - DNA, 596 bp, Homo sapiens
agtcaataattttccctccagttaatcactattctgacttacatcactgtgtctcacatttgcctattcttgaacttcatttaaatggaactataccttatgtctcatttgtgtctggcttctttaattcaacattatgttgacctgaaagttttaaagggtgaaattgttgaatatgtcacctgtctgcaaatagcaacttggtagaggactggcaaactgcctttcatccataaattcatccataaatccattatggaaaatctatccataaagataaatgaccatctttatgtggggttcttcaggaaaccttaagaaattcagcctagtaaaacctatttgtgtgcctggcaggctgctgagattcagtggtaaactgtcaggcaatatagttgtttttcaaaagaaatcaatctgactaaactaatgagagttctttcaaggaactaagtaaaagaaagcttctatttttttaacacatttttagaaaacttttctcaaaataaaaataactgttacagaatcaatacgtattactgtaagaaaaaattttcagaatatacttctgagtcctgagaggcataaaaaaaaaa

SEQ ID NO: 28526 - DNA, 354 bp, Homo sapiens
gtgaatatctggaactgttccctcaccacgaggattcctcatgctaccttttaataaccacactcctggccaggcgcggtggctcacgcctgtaatcccagcactttgggaggccgaggagggcagatcacgaggtcaggagatcgagaccatcctggctaacacggtgaaaccctgtctctattaaaaatacaaaaaattagccaggcgtggtggcggacgcctgtagtcctagttactcgggaggctgaggcaggagaatggcgtgaacccgggaggtggagcttgcagtgagccgagatcacgccactgccctccagcctgcacgacagagcgagacttcatctcaaaaaa

SEQ ID NO: 28527 - DNA, 329 bp, Homo sapiens
taaatttcaacaaatatctaatatgtaaaaaaagactacttggggagtataaaaacatagtggaacaagggtactggtcataatagtagatgagatgggcagagttcgggcatttgggcattttagggcaaagggtggcaatattaattaactctagaatttattaaatcgagtatgcttatgaaaaattataaaaagttaatcacataagaagagaaatagtatgcatgacttccaaaccagtagagagaacaccacagaatatatatttctatttttattttattttttgagaccaagtctggctctgttgcccaggctggagtgca

SEQ ID NO: 28528 - DNA, 387 bp, Homo sapiens
atgtctgggcgtggtaagcagggaggcaaagctcgcgccaaggccaagacccgctcttctcgggccgggcttcagtttcccgtaggccgagtgcatcgcctgctccgcaaaggcaactatgcggagcgggtcggtgctggagcgccggtgtacctggcggcggtgctggagtacctgaccgccgagatcctggagctggctggcaacgcggcccgcgacaacaagaagactcgcatcatcccgcgtcacctccagctggccatccgcaacgatgaggagctcaacaagcttctgggcaaagtcaccatcgcacagggtggcgtcctgcccaacatccaggccgtgctgctgccaaagaaaactgagagccaccacaagactaagtaa

SEQ ID NO: 28529 - DNA, 352 bp, Homo sapiens
gcactctctcacacacacacacacacacacacacacacacacacacacaccagccccagccactctaacttcccttccccctccactttggcctttttgtcccagtaccacttcaccctaggcccttcgctgcctagtatggtcttctctaagagctgcatggcttactcccttgcctccatggatgtgttgctcaaatgttatcttctctatgaggcctaccctggccaccctattcaaaattgtaactcctcttcccttaagctctgattcccccttatcctacgtcatttctccctagagcagttatcaccttctaacttactatatactttatttattatatttattg

SEQ ID NO: 28530 - DNA, 1025 bp, Homo sapiens
gaagagaagagcttatattctgtgagagcttcactggagagcacattttctgaacacttcctaataacgtgacttctcatcagtacaagaaaaaccaccccctggtgtttcagaacagttgttgagagggaaaacagaagtggagtatttttgtcttcagctgttcatgcatattcttactttctctctagatgtctattactgcatacacagagaataaagtgtgccaatctgacttcctaactctaattgcaatcaggttgaaatgatgagtgattcttggtccccgttcttcagaggaggtacatatggcaggttgatcaatgtttaaatggaaacgtgatctgttatatagtgagcccagcagtgaaactctcttgttagcacattcatttgtgtgtgtgtgggtcggtgggggccggattctaccttatatttttcccatactgtatttatcttctcattataaatatttctaaaataaaaatagaacaatatttctttgatttcttttgcatgattattgataagactggcattatcaaagaagaaagcacatcagtgttaacaagggagaatcggatttaaattatggcaaatttgagaagaaatgtgtaagttttagtagaaagagttagtaaaaaacatacagaaatacaaaaggattgacattattttcaccacaataatggagagtcagggtgttccatcttaggatcatggaattgtaattgaaaaaaaacatgtaaacaaaatggtcattagaggtagtgtccttagtgtgctctatattgggaggtctgaaggaggaatgagaatgaggtttgcgcctcatacaaaatatgagatcatagagggagaatttgagttatttataaaagttaattttaatctctgtgctagatggtggctctgaaaaatgcagacacattgcttctattctggttaaactaagataggtaataactgttacacttatacatcatgtttctcattcgtcattgttgcttggggaaaaaaaagca

SEQ ID NO: 28531 - DNA, 341 bp, Homo sapiens
ttgggtgtaaccttactgtctcggttcagttctgaaatctctgtgcggctccttctgtcttggtcttcgctgagacgcccaccctgtgcctcttcacttgtttcaagcgtgcctgtcattggtcactggcgcatctttgtggcggctgccctaagtctgtggcgggattccaatgtccaggccatctcagtgttgacattatggcttgtttttcttcattcaggttgagctattcttggttcttagtataaaaagtgatttccttgaaaccaggacgctctgagtgtttcatcgcgagactctgactcttgctcaatcctgtgttgtggcaggcctccttt

SEQ ID NO: 28532 - DNA, 398 bp, Homo sapiens
gtgatggttgccttcatgtcactttgctaatacagttgtttggaggagagaaagcagcttttatatattgtttattgaaaaaaaaaaatccatcttaagcactaaggaactctgggaaaaatggttacaaaatgtgtttacttaaatattgtgaaacgaggatggaaattcgcagtgcagggtatttgtcatctgctcatgactagcagatggccgcctcctcctcatcctcctttgcgagccgagtgactcacatcttacagggtgtgcaaaatgaaatttcgaaactctccagagtagaggtggcagtgccataactccatgcaggaggagtgtgccagccagattactttgccagccagcatgctgccaaaacttcacaaaatgtctctcattgg

SEQ ID NO: 28533 - DNA, 633 bp, Homo sapiens
  misc_feature (371)..(371): n is a, c, g, or t
cggcaaccttctcccagctttgtgaggtggagcccaacctccagaccaagagaggccttcctgaccttcaaccccatctccagagctccccagagctggtctagcccctcatctgacacacagagaaacggagaccaggaacctgacgctggtttccctagcccatgtgaggaccctgtagaccagctacatgcacacccagtccagccgccggacagcgttcagtggggaagagagcagaccatcgtccacccacattccagactccaactggcagaggggaggggacgttggggctgcagggccactaatgtggacggggacagagccccaggggacagcctgtgctgggggacgtatgggggcaggantcagaccccacagtgcctgcgggccacaaggccaagacaggatctggtaagtgacgatttggaggctggtcctgaggtgcaagagggagtgcccagggacagagagggcaccggggtgactacagtccctccagactcacatctacccgcacctgtgggtggggccttatttgcatacagggtctttgcacacgtggttggttacaatgaggatgctggagggggtggtctgtgtccctgttaacaactcatgtccttaaga

SEQ ID NO: 28534 - DNA, 250 bp, Homo sapiens
tgggatttcaggtgtgagccaccacacctggcctttactatatttttgagggttgttccttttttttctttttagtggttgctctaaggtttacaccttatcagaatcaactgataagttcctatttatactagtttaattccagtgatacaggtatagaaaagttattcttatgtcattctattcccttttccatctttgtgtggtatatttgttgtacatattacatctaataatgttacaaaccatt

SEQ ID NO: 28535 - DNA, 485 bp, Homo sapiens
tgtaagatgagattagtgcctaccttatcatgctattgcttggattaaagctatctggcatatcccaaatttttagtaggtggagatggtggtactggtatatgtagtataccttccaagcacacattcaggcagtgggcaggtagggaaggtgggcaacttgccgcagcagagaggaggaagaagttcagaccgttgggtaggataagtggatccaacccctttgtagggcaggtggtggagtgggcagataaagagccaagccctagtttgagtgacactgtggggattcaagaagacttttgtcacgtgtgtagtgcagtgactagctcttacctctggttcagtactaaccatgctaacagacctgcagagtaccagcttgtgggtgattatgtaccaaacacttgtatcacgtttattgaacagtatgctctaagtcactttgaaatgaataggatgaataaaggtaagggaatttataa

SEQ ID NO: 28536 - DNA, 381 bp, Homo sapiens
tttgtcattacctaaagatggcttttaagcatgtaggttggtgacatcaagttctttggaaaggtatatattttttgcctttttaacttatgtatactttcctttttaactctgtgtcagtcaggataaattttttagcctgggcaacatagtaagatcccatctttacaaaaaaatgaaaaaattagcaaggtgtgatggcatgttcctgtgcgctcagctacttgggagtcctcagactcccaaggactcttgggaggatcacttgagcctgggaggtcaaggctgcgatgagctgtggttatgccactgcactacagcctgggcaatagaatgagaccctgtctcaacaacaacgacaacgacaacaacaacaacaac

SEQ ID NO: 28537 - DNA, 533 bp, Homo sapiens
ttttcaaacactttggaagcggggggggggagattcccttaattccggagggttagggttaaaataacccttttttttccccccccccttaagcttaaggccaaaaatgggccccttttcccaaaaaaaaaaaaaaaaaaaaaaaaaaggaatcagtttggtcaaatattgctgaatcagcttggtcaaatactgctgacaggtgaagtaagacaaaggtagaattggtcattacatatcatgtggcagttattggtgaccttaatgaacaatttcagtgaaatgctgagtgtagaagcctaattggagtggatttgaagagaccaggtctctagacgttgagcatcagtggttgctgatatcacagagatactcagatatattgtgctccatgatgaaaaaacgttatcctctatgaagtgatcttaccagagaagaggagaatcgcttgaacccaggaggtggaggttgcagcgagccaaaatcgcgccattgcactccatcctgggcaacaggatgagactctgaaaaaa

SEQ ID NO: 28538 - DNA, 338 bp, Homo sapiens
tgaaaccctatctctactaaaaatacaaaaattagctggactcagtggcacgtacctataatcccagctacttgggaggctgaggcaggagaattgcttgaacctggggggcggagcttgcagtgagccaagatcgcgccagtgcactcctgcctgggtgacagagtgagactccatctcaaaaaacaaacaaacaaacaaacaaacaaacaaaaagagattctgcttgagtctttccattcttaaacatgattaatgtacgaaatatacaaaaaatgtacaaaatgcacataaatgtacagacaataaaaaattaaaaataaaaaatgataatccat

SEQ ID NO: 28539 - DNA, 793 bp, Homo sapiens
ggagctctttgaataattatttaaaagaaacgtaaccttgataatctctgaatcacacaaaggacttgaaaaattaaagcattaaaaaacaagtaatagccactactacatagtggtgtcagtcctagtagcagtaactcctgtcttagatgttgattttctgtggggattttttgttattttttttaaacattattaattttaattagttaatttttatttataattgacacataataattgtacatatttataccctaagggtgattatacattgtataatcaaatcagggtaattaccatatctatctctttaaacattcatcatttctttctggtaacaacattcaaaatctggcaacattgttatttgctatagccaccctgctacgtaatgtgaatcaagggctttttgttcatgctatttgacccttgtttttattactgtatttcctaaagatataaatatggacacataattatatacagaattgtttagtgcaaaaaaaaaaaaaaaaaaaaaaaaaaaaaatttggggggggcttgggccccggaaaaccttcataaaccacttgcggtggggcggcgggggccccacggggtacgcgcgacactgggcacacacggccccaaaaggaaaccccgggacaaggacaaggggcgggggttctctcaccaaataaaaaagcgcccggggggaccaccgagcgcgccggaaccaaccccaagaagggggcccggacggccaaaggggaccccacacccgaggtccaaggagaggcgaaataactc

SEQ ID NO: 28540 - DNA, 664 bp, Homo sapiens
agtagctgagaaaggatttcaattcgaacatactaattcctaagtttacgtattctagaccacagtactaaggtgatttcctagccagagtgtgcaatagaatcatctgtagaacacatctcattgctttgtgcacctcattctgacaaattccccttgaagacaaatcagaattgggaaaggcccacaggttactttcctttccttgagaaccactaggtgagaagacttctgtggtgatgtcaaattacatttcatattacagatatgaacatagcgtgatcctgatgtgtgatagttacagatagatcactagctagtagatcagaataaccccataatattttcatttgagtaacattttaacatgtactaagttgtgttacctacactacagctgtatcagtggagagagggattgtagtgtaactttttccaaatgagtgaattaagactgaaattcatgagtctactaagaatgaatttatgaaaacataagtctgctgatctttttgaccacttctttctggaatggcatgggttttagcttatgcaccaacttcagtggcttggaaggcaggattgggtagtacagttgaccgttggacaacacaggtttgaactgcagaggtctacttacatgcagattttcttctgcttctgc

SEQ ID NO: 28541 - DNA, 1366 bp, Homo sapiens
  misc_feature (1)..(1): n is a, c, g, or t
  misc_feature (6)..(7): n is a, c, g, or t
  misc_feature (10)..(10): n is a, c, g, or t
  misc_feature (113)..(113): n is a, c, g, or t
  misc_feature (243)..(243): n is a, c, g, or t
  misc_feature (1017)..(1017): n is a, c, g, or t
  misc_feature (1147)..(1148): n is a, c, g, or t
  misc_feature (1184)..(1184): n is a, c, g, or t
ngatgnnacncgactccagttctggctgcccgcgggcctctttccaaccagccaggcctcacagagcaaggcatccccactggagagaattcgatctgatgtttcataaagcnctttatttaaggagaaggggcatggtctgtctccagtctgtctgcagatcagattgtagcggcaaagaaaacaaaggagataacaattgtaatcataatgaccctctttatgaaaactcatcttgatgtnctccaaatcaaaacaacaattcaggcaatattcaagcaatggccaaaatcatccaggccattaaatcatccaggccattgttttacaaaattcctaaggtctgatcaggcttcggacttgggcctagctgggtcaagagaacctgaaatgctgttgtcaagagactctgaaatcaccagtttaatcaggacagctaatctctacatccttgacctctcttttgggagagactttcttgagagaggacactacaggactcagctacagagctctgctatacatgggtgggagtggaggccgccaccccacctggaactgtgagtgaaaactctagtaatgatcttgaggggtgaagggaggtaggtggggtgtgggtgatgagggaggccaaaccccaatctggaaggatctgtcactgaaacaattgcttggtcgagacctctaatttttcttcctctccagccagtctcctgtggctccctggtgctgggtttctggcctttggtgacatcctaacagaagggtctggaagcagggaccccagacaccttgctccctctcccaaatcacacccaaaacatactggggtgaacactgtctccgaagagtttaattgagtcgttgacaaatctccgtttctttctcttccgttgatcgtttgactcgtgaatgtcacacggtccggaacacgactattgtactaatagtgtacttataaattaaattaggactgttattgtaatagcttagtgttacactcccggtgccggaatnctgaccccagggccgatcgtgtagagcctatggtgtatcttaatcgaaacccgtggcccaaacatctcagccaggaacctgggactttaggtgtcattaactcttcacacctgttaactacacctatctnnataggggctccacatcagtcaggcaacttttcttcntgggcattctctaatgagagaagtctgagattagaaatttgcggattaatgtctcgaagggctaatggagtgaaaagatacattgattgctggcttttcttcttagaaaaaaatttcaattgtggatgtaatagaaataccattaaaataatatttctgggtagcagtcgacagatgaattc

SEQ ID NO: 28542 - DNA, 316 bp, Homo sapiens
acaccattttcaatgtagatcatgagaagttaacaataatattagaaaccctacagtcaccctgcccagtgtggtagcaggtatccccaagtggctatttatatttaaattatttaaaattaaacgtaattgcatacccagttccttcagttgcccgagtcacatgtcaagtgctcaacagctacaggtggccagtgcctgccatactggacagtgtggatacagcgcattccatcatttctggaatttctaacaaaaagtactgtactaaacaaactacttaaaaaaaggtagcactaataacgcaatagtaatt

SEQ ID NO: 28543 - DNA, 2432 bp, Homo sapiens
ctcatgggccagtttggaaaaagattactgagttggagccgtctcaaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccatggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattggagcagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaaggagtctcatgcaccacctatcacactccctcacatcctgtttctgactttggaatggactcaggaaaactaggcccctctttaaaccgtgtgatgtatttgaatgtctgttatttccagccaccctaacattcttcttcctgtgtggatgcttatttgtcaatcagtaaatttgttcgtaaaga

SEQ ID NO: 28544 - DNA, 2557 bp, Homo sapiens
ctcatgggccagtttggaaaaagattactgagttggagccgtctcaaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccatggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattggagcagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaaggagtctcatgcaccacctatcacactccctcacatcctgtttctgactttggaatggactcaggaaaactaggcccctctttaaaccgtgtgatgtatttgaatgtctgttatttccagccaccctaacattcttcttcctgtgtggatgcttatttgtcaatcagtaaatttgttcgtaaagaaaattacttctggtatttaggctgtgaatgtaccttgaaggggagagttcatggagagagcatgtgttctctgattgtgaggtcactgtgaatgattaaattggtaagggtaaagtaaaaaaaaa

SEQ ID NO: 28545 - DNA, 447 bp, Homo sapiens
ctaggccccccttagaaaaaataactgttgcccaaagttggtgcagggaaagtacccagatgggtgtaggcccatccttggctatgcccagaaagtaaggaagggatggaagaaaaatagggacgtccttgaagaatacaggatcaggagtggaggtttggggcataaaacaatgatagaaatgaatgatcatccatagaataaaataagaattcatgagtccatactgataaaaatcaataaatggaaaatgaaactgtcttaccttagtgtaatataaagtgataaatgtagaatcgtgaaattagaagatcaccaccaagaaaaccatcaggcaagagtcaccactagaggctacaaaactagtgggtgaaattctgaggaaaagcataatttttttttaaagtatctccctacaagatacttaaaactacaaaggaaaaaaaa

SEQ ID NO: 28546 - DNA, 1101 bp, Homo sapiens
atggatttcttaaattcatctgatcaaaacttgacctcagaggaactgttaaacagaatgccatccaaaattctggtgtccctcactctgtctgggctggcactgatgacaacaactatcaactcccttgtgatcgctgcaattattgtgacccggaagctgcaccatccagccaattatttaatttgttcccttgcagtcacagattttcttgtggctgtcctggtgatgcccttcagcattgtgtatattgtgagagagagctggattatggggcaagtggtctgtgacatttggctgagtgttgacattacctgctgcacgtgctccatcttgcatctctcagctatagctttggatcggtatcgagcaatcacagatgctgttgagtatgccaggaaaaggactccaaagcatgctggcattatgattacaatagtttggattatatctgtttttatctctatgcctcctctattctggaggcaccaaggaactagcagagatgatgaatgcatcatcaagcacgaccacattgtttccaccatttactcaacatttggagctttctacatcccactggcattgattttgatcctttactacaaaatatatagagcagcaaagacattataccacaagagacaagcaagtaggattgcaaaggaggaggtgaatggccaagtccttttggagagtggtgagaaaagcactaaatcagtttccacatcctatgtactagaaaagtctttatctgacccatcaacagactttgataaaattcatagcacagtgagaagtctcaggtctgaattcaagcatgagaaatcttggagaaggcaaaagatctcaggtacaagagaacggaaagcagccactaccctgggattaatcttgggtgcatttgtaatatgttggcttcctttttttgtaaaagaattagttgttaatgtctgtgacaaatgtaaaatttctgaagaaatgtccaattttttggcatggcttgggtatctcaattcccttataaatccactgatttacacaatctttaatgaagacttcaagaaagcattccaaaagcttgtgcgatgtcgatgttag

SEQ ID NO: 28547 - DNA, 430 bp, Homo sapiens
  misc_feature (48)..(48): n is a, c, g, or t
  misc_feature (56)..(56): n is a, c, g, or t
aaatggaaaaccccctggccttaaccggcatccctccccggggccttnaccggccntcccaggagggttcccccctcaacccataaccgtataccccatagctcccttcctgtcattccatgtaaatatttgtaagctttttcctcccttcaaaggaaactaacatttctcttccctctgcattgtgtgagagagttttagacagtcttcatttaaaaacatgaaaaatgatgttagccttgttttcatttctagcagccttacattgtgtatattttctttctcattcccaaaattctaatctgcattactacccattcaatgccatttacctcaaaatgttgaatgctcctttatctttgttatctggtttctaatccttatcacaactgaaatttctgttttaggtgttattactgacttttctctg

SEQ ID NO: 28548 - DNA, 177 bp, Homo sapiens
atctgacctctgtttatcagggtcaggcgcgccctttgcacttttacgtttcctttaattatttcggacttgatcgtggcagggagcaagggggaaaaacaataccccagccctcaccagctaccctcgaagggttaaattttaaaccgcggtttctggaactagtccggaaacgca

SEQ ID NO: 28549 - DNA, 566 bp, Homo sapiens
cgtgtctgtttctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaagtttcagggtagaaagggtccctttaactcctgaagacagtaaatcacagtctgtgtggtggttctcagaagacacttaaaggactgaactggatgctctacatagcacccttgccaaaagggttcggaaatgacttccagcttcccacagtaataaaatggcactgtttggcatcttcgaggtaataaaagtgaattttttccattctagt

SEQ ID NO: 28550 - DNA, 843 bp, Homo sapiens
cgtgtctgtttctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaaggttacagaccacttactctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactttggaatttgaagagagcttgataactgtgttctatgtggatccagcattacaactgataagtgaaagaaaagaaagaaaacatggaggggaaggtgataggaagatggaggcagagattggagtgatgcgtctacaagtcaagggaaaccaaggattgctaacagctgtacaaacttaggagagagacatggaacagattttccatcgaagcctcctgaagaaacaaaacttacaacttgattttggatttcttgcctccatgactgtgagagaataaatttctgttgttttaagccacccagtttgtagtca

SEQ ID NO: 28551 - DNA, 5706 bp, Homo sapiens
cggcgaacagacgttctttctcctccatgcagttacacaaaaggagggctacggaaactaaaagtttcggggcctctggctcggtgtgtggagaaaagagaaaacctggagacgggatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 28552 - DNA, 6361 bp, Homo sapiens
  misc_feature (6361)..(6361): n is a, c, g, or t
cggcgaacagacgttctttctcctccatgcagttacacaaaaggagggctacggaaactaaaagtttcggggcctctggctcggtgtgtggagaaaagagaaaacctggagacgggatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagtaaaaaaaaacaaaaaaaaaaaaaaaaaaaaaaaaagagacaccacacaaaaaaaacaattcacccagagaggcgacaaccgaaagtcagcaatgcaaccaaaatgtagtataaacaagaggtcccccgaaagggagagccagatcataataaagagacagagacctagcgacacatatcaacaaccagcgcagcgggacacccaacggcgtcaggcatactagtgcagacacacacatatattaggagcatggaacaagaatgggacagacacacacaaacggaaacccgcgcaggaggaaaaacaacaagacccagcgctagatcacgggcaccagaacggaagcacaccgccgcgacaaaccccggcccacaagcggaaaagagcaaacagaataaagcagagcgaggaagacagtagaggaggcagagcggaaccaacaacgagacgagggagagcagcacgccgagaggacgcgagaggatagcaacgcagacggcaagagcgcgcaagacgcaagagaaaccaccagaggagggaccgaaggagcgcggcagcagacagaaagcagagcaaacgccagcaagagaggacaggcgagacgacgcagggcgagagtggcaagagaggcacgcaccgcagaccacccaaagagn

SEQ ID NO: 28553 - DNA, 6021 bp, Homo sapiens
cggcgaacagacgttctttctcctccatgcagttacacaaaaggagggctacggaaactaaaagtttcggggcctctggctcggtgtgtggagaaaagagaaaacctggagacgggatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagtagttaacatgtgaacttttatgtatgatacataattggctttaacatgttggtccattcccaccttggtttaagtaacgtcataccaaagtccatggatatatgaaaggatacaattaagttgcctgtttgttctttatgctgaaaggaatatatgtcttccaattgcccactacatatgcacaaaatctgctggataagttttaagagggatatattctgaaagcatttttgtttgttgcattgtaccaggactaaaaaaagaaggattggaagttctgccatcaaatttgggtatcataaaaagtttttaactg

SEQ ID NO: 28554 - DNA, 5805 bp, Homo sapiens
cggcgaacagacgttctttctcctccatgcagttacacaaaaggagggctacggaaactaaaagtttcggggcctctggctcggtgtgtggagaaaagagaaaacctggagacgggatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggactgacatcacatggtctgagagcccatcttcaagatttatatcatttagagctactcttaggccagatagcctgagcagacagacatgatgtgagttgacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 28555 - DNA, 5609 bp, Homo sapiens
cggcgaacagacgttctttctcctccatgcagttacacaaaaggagggctacggaaactaaaagtttcggggcctctggctcggtgtgtggagaaaagagaaaacctggagacgggatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 28556 - DNA, 6222 bp, Homo sapiens
cgtgtctgtttctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaaggttacagaccacttactctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactttggaatttgaagagagcttgataactgtgttctatgtggatccagcattacaactgataagggtatttatggcacaatgaaaaattcatctttcccagaatgatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 28557 - DNA, 6390 bp, Homo sapiens
cgtgtctgtttctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaaggttacagaccacttactctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactttggaatttgaagagagcttgataactgtgttctatgtggatccagcattacaactgataagggtatttatggcacaatgaaaaattcatctttcccagaatgatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 28558 - DNA, 5614 bp, Homo sapiens
cgtgtctgtttctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaaggttacagaccacttactctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactttggaatttgaagagagcttgataactgtgttctatgtggatccagcattacaactgataagggtatttatggcacaatgaaaaattcatctttcccagaatgatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactga

SEQ ID NO: 28559 - DNA, 3818 bp, Homo sapiens
gagtaaatcatcatgacagataaatattacaattgtcactcatcagctactgaaaatcactttggttctaaaagcggtcaaaactaatgatagttttctaatggatacaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 28560 - DNA, 6304 bp, Homo sapiens
cgtgtctgtttctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaaggttacagaccacttactctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactttggaatttgaagagagcttgataactgtgttctatgtggatccagcattacaactgataagggtatttatggcacaatgaaaaattcatctttcccagaatgatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggtggcataaatcttaatatattattacaggactgacatcacatggtctgagagcccatcttcaagatttatatcatttagaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 28561 - DNA, 6397 bp, Homo sapiens
cgtgtctgtttctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaaggttacagaccacttactctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactttggaatttgaagagagcttgataactgtgttctatgtggatccagcattacaactgataagggtatttatggcacaatgaaaaattcatctttcccagaatgatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccagctactcttaggccagatagcctgagcagacagacatgatgtgagttgacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 28562 - DNA, 6275 bp, Homo sapiens
cgtgtctgtttctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaaggttacagaccacttactctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactttggaatttgaagagagcttgataactgtgttctatgtggatccagcattacaactgataagggtatttatggcacaatgaaaaattcatctttcccagaatgatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggactgacatcacatggtctgagagcccatcttcaagatttatatcatttagaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 28563 - DNA, 2756 bp, Homo sapiens
gtccacagtccacaacttgcacgctgtcattatagtcacccttgtgcacgcgagtagctgttgttaaaattaccatttagcggtagagtatccatggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 28564 - DNA, 2641 bp, Homo sapiens
gcgcggcccccacgccagacggccctccctcggggcgcgctcgcagacggagatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggttgcaactatttacagttgggaatgcaggaaagcctggcacttttcaagtgttagctttcaaatacaactttgtcctgaacgacattaaaaagttttgtacaaaagaaatagagtttctgtggaaaggaacagagacagtaatgataactccccctcttctgtttcaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 28565 - DNA, 5283 bp, Homo sapiens
  misc_feature (5283)..(5283): n is a, c, g, or t
cgtgtctgtttctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaaggttacagaccacttactctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactttggaatttgaagagagcttgataactgtgttctatgtggatccagcattacaactgataagggtatttatggcacaatgaaaaattcatctttcccagaatgatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggtggcataaatcttaatatattattacaggactgacatcacatggtctgagagcccatcttcaagatttatatcatttagaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagctcttaaataaaatataaatgaacaaaaaaaaaaaaaaaaaaaaaaaaaaaaaaaaaacaaaaaaaaaaaaaaaaaaaaaaaaagagacaccacacaaaaaaaacaattcacccagagaggcgacaaccgaaagtcagcaatgcaaccaaaatgtagtataaacaagaggtcccccgaaagggagagccagatcataataaagagacagagacctagcgacacatatcaacaaccagcgcagcgggacacccaacggcgtcaggcatactagtgcagacacacacatatattaggagcatggaacaagaatgggacagacacacacaaacggaaacccgcgcaggaggaaaaacaacaagacccagcgctagatcacgggcaccagaacggaagcacaccgccgcgacaaaccccggcccacaagcggaaaagagcaaacagaataaagcagagcgaggaagacagtagaggaggcagagcggaaccaacaacgagacgagggagagcagcacgccgagaggacgcgagaggatagcaacgcagacggcaagagcgcgcaagacgcaagagaaaccaccagaggagggaccgaaggagcgcggcagcagacagaaagcagagcaaacgccagcaagagaggacaggcgagacgacgcagggcgagagtggcaagagaggcacgcaccgcagaccacccaaagagn

SEQ ID NO: 28566 - DNA, 2068 bp, Homo sapiens
cagtgaacctctacagaggaaacaaatgctagcaagacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 28567 - DNA, 2815 bp, Homo sapiens
cgtgtctgtttctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaaggttacagaccacttactctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactttggaatttgaagagagcttgataactgtgttctatgtggatccagcattacaactgataagggtatttatggcacaatgaaaaattcatctttcccagaatgatatgaagatcaatgatgcagactgatggtcttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagacgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggtatctctcctgtgctgtcaccctgctttctcccttcttcagctacctgccacgctttatcatcttgctgcatgatccaatgtatttcagtctttgataattatataatgtgccccatatcagctgtacaaatgttggcttttcacaggtatattactctcagaataagcaaataatttacttttaatgatttctgctgtttttccattcatccaaaagtacacgaattttaatgaaatatcctcttaattggaaagtaatt

SEQ ID NO: 28568 - DNA, 326 bp, Homo sapiens
gaaacttacaaagtaaatggaagaagggtaacttaagtaataaaaaacaaagcaagcccaggcacccagcactttggaagaacaagaaaggcggacaccttgagctcaagagttcgagaccatcctaggcaagacagtggaatcccatctctaccaaaaatataaaaaaattagccaggcctggtggcgtgtctgtggtcccagctacttggaaggctgaggcgggaggatcacttgagcctgggaggcagaggttgcagtgagccataaccatgctgctgcactccagcctgggtgacagagtggccccatctccaaaaaaaaaa

SEQ ID NO: 28569 - DNA, 476 bp, Homo sapiens
gtcccgtttttcctcagaagggctactctttggaactcagtccatggtgagctgaagctggctcacactggctcatgagacctggctgcacatctctgggtcagcagcatgacattggtagcttgaaactgacaaatccttcaaattagcaccctccctttctcccactgaggaccaattattaaacatacaccagctcaccacctaattcaggttacctgattgcttcatgatggtagctctttgggctcaagaaaaggaacatttttgtataatagattatctgactttttcttattggtataggagcaatattctcgagttttatacattctaagcagaagtagaactcagtgttgtttttgttttgagaactagtgaggtagaacagtttattcaagttcattagccgttagaattccttctttatggaaaggatgttgaaaggtgaaccacataatagatcacagtcatgg

SEQ ID NO: 28570 - DNA, 351 bp, Homo sapiens
gatgctttggagtagattgaagtaaaatcagcaagtgttgtgctaactctaaatccactccaaagatcactttttgtagctagcttttaggtcagagactctgtatcttctttaggattattcagacaggacttatgtattctcctaggaaggagtgttcctttctagctcttcaaaaacaaaacacttgattgttcttggaattattattttttaattattttttatagagactgggtctctgttgcccaggccgctgtcaaactcctggtctcaagcagtcctccaaccttggcctcccaaagtgctgggattacacatgtgagccatcacatccagcctttccttgga

SEQ ID NO: 28571 - DNA, 375 bp, Homo sapiens
  misc_feature (326)..(326): n is a, c, g, or t
  misc_feature (338)..(338): n is a, c, g, or t
ctggtcagtgatacagaaacaaactcaattcaacttggattctccctgaatcctgaaaatgtccctgagttctgaaatggttttgatggaagctagaggtcaatgattatcaggaagaatcagaaaggctcaattggggtgctgcaaggcctgattacacagagttattaatcacgtttcattcttctccaatcatcatgttctgatctgccctccaaaaggagaaacaggaaaatgggagtgtctggcaaccttttcacatacctcacagggggaaggcaggctggcaataggaggtgggtgctgggagggcaggatggaacccntcactttgttanttaggagggagtttttaggggggaatttggggacatc

SEQ ID NO: 28572 - DNA, 522 bp, Homo sapiens
  misc_feature (1)..(2): n is a, c, g, or t
  misc_feature (7)..(7): n is a, c, g, or t
  misc_feature (10)..(10): n is a, c, g, or t
  misc_feature (13)..(13): n is a, c, g, or t
nnattcncgnccncgcagattctgtggttatactcactcctcatcccaaagaatgaaatttaccactctcctcttcttggcagctgtagcaggggccctggtctatgctgaagatgcctcctctgactcgacgggtgctgatcctgcccaggaagctgggacctctaagcctaatgaagagatctcaggtccagcagaaccagcttcacccccagagacaaccacaacagcccaggagacttcggcggcagcagttcaggggacagccaaggtcacctcaagcaggcaggaactaaaccccctgaaatccatagtggagaaaagtatcttactaacagaacaagcccttgcaaaagcaggaaaaggaatgcacggaggcgtgccaggtggaaaacaattcatcgaaaatggaagtgaatttgcacaaaaattactgaagaaattcagtctattaaaaccatgggcatgagaagctgaaaagaatgggatcattggacttaaagccttaaatacccttgtagc

SEQ ID NO: 28573 - DNA, 471 bp, Homo sapiens
atttttacagtacaaccatacctcagagatactgcaggtttagttccaataaagtgagtatcgctataaagcaagtaaaagtaagtgcaataaagtgagtatcgctataaagcaagtcacacaaatttttgtttcctagtaagcatgagttatgcttaaactatattgtagtctattaagcgtacaatagcatgtctacaaaaacaatgtataaaccttaatttaaaaatatttttactaaaaaatgctaatgatcatctctgctgtcagtgagttgtaatctttttgctggtggagggtcgtgccttaatgttgatggctgctgactaatcagggtagtggttgctgaaggttgggtggctgtgacaatttcttaaaatatgaaaacaacgaagtttgccatatcaatcaactcttcctttcacaaaaaaatttccctgtgacatgcagtgctatttcatagcattttac

SEQ ID NO: 28574 - DNA, 382 bp, Homo sapiens
gtggtgtctgtgatctgactttgagagacatctggctctgtttcagaagaactaaaaatgcaagtgctgtaaagctttaaagcagcccatgtttatctcaagttgaattatccaggcttgcttacaaagatgagagaaaagtggcctgtaaaatgacagagaaaaacatgggcaagagagggcttaataaaggggttaaccaattccataaagaagactggaatttattaaagaggcattgtagccactcggggatcaataattttgatttgatttttaagtacttgtagattttcttttaactagaggcattaatccgaaagcagcatgtttcattgaaaactgcatcactaaacccaataaaaagtcctagcagaaaaaa

SEQ ID NO: 28575 - DNA, 388 bp, Homo sapiens
tcactaggaaaatgcagattaaagtcacagtgaaattctactttgggaaacagttggacagttctttattctgttaaacataaaattagcatattagcagttttactacttggtatttactcaagagtaacgaaaatataagttgaggccgggcatggtggctcatgcctataatcccagcactttgggaggccaaggtgggtggatcactaggtcaggagtttgagaccagcctggccaatatggtgaaacctcatctctactaaaaatgtgaaaattagccaggcgtagtggcaggcgcctgtatcccagctacgtgggaggctgaggcaggagaatcgcttgaacctgggaggtggaggctgcagtgagccgaaatcatgccact

SEQ ID NO: 28576 - DNA, 440 bp, Homo sapiens
tcttccagaattctgttgtcgtcacaagaagtctgttgtgttgatttgaactgtgaatactatctgacattatattacctgtattttcaaagtaatttgcctttcaattccttgtacttgtgccaggcagcgttagttggtagtaagcccattcttttttctacaatgtttcactcttgcttcaaatataccaactattctgtaggccagagttcaaaacaaaacaaaacatacgaaaaaccaaataatactgactaaagatactaaaatgtcacttgtttcaaattttttctcatttaatatttactgcctaattttgaagaaatatctttccagtctttaataaaaatgttacacctgtaatcccagcactttgggattacacaggcggatcacttgagctcaggagtttgagaccagcctgagcaacatggtgaaac

SEQ ID NO: 28577 - DNA, 1050 bp, Homo sapiens
  misc_feature (957)..(957): n is a, c, g, or t
tgctgcctctccagccaagtggctggagtcgggaggctggaaagagactccgagaaagtaccagcggaaggcggccgccgctacggcgattcgcagggagtagcagacgaagacggtggccgccgcactagccaccacgtgtggaggataaacggtctacacggccattccggcgccgagtctagggaaagagttagcgacgacggggaaagaaaatgtgaagagagcgaccgccgctccagggtcgctgcaggaagcctaagtgcagacgccggcttctcccgcagtgacttgagaagggtcagtgaaaacctcggccactgccgcagcgtctctagggagagagttaggggagatagtggccacagtcacagctgctcttgggagagagttaggggagacagcaccttctgcagcagcgacgtgaattttagtgaagttggaggccaccaaactaccgactccaggggaacagccagagaagaccgaggcctccgcctcagtggtccttgggagggagtcagtgacattcgggacccgcgaactagtgacttcggggatagagtcagtgacgatcgcagtcgccgcttcagtggctcctgggagggagggagtgtcgaaggcggccacagcgttggtagttcttgggaggaagtaagtggagaccgcggctacgcagccagcgactcctctggtgtgagcggcagtgaagacgccagctaccgcttcagtggcttttgggagagagaaagtgaagacgaaggtttccgctgcagcttctgggagagagcaagagaggaccttgggccccgtcctagtgacgacggagaagagggccgctgccgctgcagtggctcgtgggtgagagcaagtgaagacgccagctaaccgcttcagtggcttttgggagagagaaagtgaagacgaaggttccgctgcagcttctgggagagagcnagagaggaccttgggccccgtcctagtgacgacggagaagagggccctgccgctgcagtggctcgtgggtgggagcatctggtgtaagccgaa

SEQ ID NO: 28578 - DNA, 1275 bp, Homo sapiens
tgctgcctctccagccaagtggctggagtcgggaggctggaaagagactccgagaaagtaccagcggaaggcggccgccgctacggcgattcgcagggagtagcagacgaagacggtggccgccgcactagccaccacgtgtggaggataaacggtctacacggccattccggcgccgagtctagggaaagagttagcgacgacggggaaagaaaatgtgaagagagcgaccgccgctccagggtcgctgcaggaagcctaagtgcagacgccggcttctcccgcagtgacttgagaagggtcagtgaaaacctcggccactgccgcagcgtctctagggagagagttaggggagatagtggccacagtcacagctgctcttgggagagagttaggggagacagcaccttctgcagcagcgacgtgaattttagtgaagttggaggccaccaaactaccgactccaggggaacagccagagaagaccgaggcctccgcctcagtggtccttgggagggagtcagtgacattcgggacccgcgaactagtgacttcggggatagagtcagtgacgatcgcagtcgccgcttcagtggctcctgggagggagggagtgtcgaaggcggccacagcgttggtagttcttgggaggaagtaagtggagaccgcggctacgcagccagcgactcctctggtgtgagcggcagtgaagacgccagctaccgcttcagtggcttttgggagagagaaagtgaagacgaaggtttccgctgcagcttctgggagagagcaagagaggaccttgggccccgtcctagtgacgacggagaagagggccgctgccgctgcagtggctcgtgggtgagagcaagtgaagaccgccgcagcatcaggggcctggactcaactcctccccagagtcggaggtgttgcgccatgcccggggtggccaattcaggcccctccacttcctctagggagactgcaaacccctgttccaggaagaaggtgcattttggcagcatacatgatgcagtacgagctggagatgtaaagcagctttcagaaatagtggtacgtggagccagcattaatgaacttgatgttctccataagtttacccctttacattgggcagcacattctggaagtttggagtgtcttcattggctgctctggcatggagctgatatcacacacgtaacaacgagaggttggacagcatctcacatagctgcaatcaggggtcaggatgcttgtgtacaggtaataata

SEQ ID NO: 28579 - DNA, 731 bp, Homo sapiens
gggccacaaagcaaagccctgtctctaaaaaacaaacaaacaaacctccaaaacttctttcccttccttggtctgccctaggccctctgagtatagataacccctcttagaagcagcatggcaaggcggtcaggagcccaaatgggaaaaagaattaactggagaccacgtagggggtgagtcctcttacacacaggccagttactcacacagacaaaaattagttactggcagggaggggtaaaggcctacttagcttgcattttcgtaccatttggtatgccatcacttgcgagtttgagtgtgagttctgtagctcatggctgcatataatcacgggcagatgacagcaagacttcccagactcactttccacatctgtaaaattgaggtggttatgagaaaacaaaacaaacaaaaagaaatgaaaatcctgaactccagagggtcaccaatactaaggcatatgctaagttagtgttttataaaataggattctatgtgtcattctataatagaatgacattatacaataacttaatcaagtactttttcatgcataaaaggtattttgtgaaagttcacagctccacagaaccctacttgtctggtcaagctgtaacttagccagtacctgattacagaagctccccaagggttccagtctgtccgttcttttttcttttcttttcttttcttttcttttttttttttttgagatggagtcttgc

SEQ ID NO: 28580 - DNA, 1436 bp, Homo sapiens
tatttgtagctattggaaataagattattttcttggtttattttctagattgtttgctcttggcatacagaaatgctgctgatttttatatgctgactttgcatcctgcaattttactaaacctcagttctaacagttttctggtagagtccttaggtttttctaaatttaagatactattgtctgcaaacaagggtaatctaaatttttccttccaatttggatgccttttcttttcttctcctgtttaattgctctggctaggacttccagtaccacgttgaagaaaggtggtgaaagtgggcttccttgccttcttccagatcttacaggaaaggcttttagattcccccctcatgatactagctgtgggtttatctgtctgtggcttttattgtgttgaggcatgttccttctacatccagttgagtttttatcatgaagggatgctgaattttactgaatacttttttggcatctatagaaatggacatatggttatgtccttcattcttttgatgtgatgtatcgcatttacagatctgaatatgtattaggtggttctcacattgctataaagaaatacctgagactgggcaatttatataaaaaaagagttcattggctcactattctgcaggctgtacagcaagcatgacagcatctgcttggcttctggtgaggcctcaggaaatgcataatcagggcagaaggcaacaggggaacacacatggccagagtaggagagagacagagagcagggaggtttaaacaatcagatctcatgagaactcactaactatatagtagcaaggggagatggggctaaaccattcatgagaactccactcctatgatccaatcacgttccaccaggcccctcctccaacactggggattacaattaaatgtaagatttgggcagggacacaaacacaaaccatatcagagtatgttgaaccatccttgcatccctgggatgaatcccacttgattacaatgaatgatcttttaaatatgtagttgaatttggtttaaggattttgcatctctgttcaaagatactggcctgtagttttcttttagggtttttatggttttaggtctaacatttaagtctttaatctttcttcatcttaatataaatgaaagctccgtggccgagcacggtggctcacacctgtaatcccagcactttgggaggccgaggcgggcagatcactaggtcaagagtttgagaccagcctggcccatatgatgaaaccccatctctactaaaaatacaaaaattagccaggcgtggtcacgggtgcttgtagtcccagcaacttgggaggctgaggcaggagaatcgcttgaaccagggaggcagaggttgcagtgagccgagatcacgccactgcactccagcctgggtagcagagtgagactgtctc

SEQ ID NO: 28581 - DNA, 2355 bp, Homo sapiens
gaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgcctgttcccttcttttcgccaggtttgcatccaagagaggggaggacaggggcaaaaggatgcagggaggctgctgatttccactgaagagctaatttcctgtgagacattaacagtgatttaagaaaaagattcctgtaactgtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatgtggtttccagcattcctcacccagtccagggacactgtgggtgtgcccagcttaagtccagtaactggaaatacaagcccaagttctggagagtttgagctgcagagatatatatgggaacactttgaatcttgactcattggccataaccagcagagtggaaaatacaagaagagaaaaaaacattgaactgcgattttataacatcctttactaggcagagagaagaggaaacaccaggaaagaaaactgtattacgatgtgaaaacttaatgttgagaaattcaggcatcttggggttagtgaggagaagttttaggggcttagattcttctaaacacatgtacagaaatgcatatttcatctgatatcaaatggcatttatagtgctaatctttacctcaagacttcacatcttttggtgattgcatcttttaggtttatagcagctaagtttgcatgaaaacaccagggctgtttcatttcagtcaagaattaatgttcattgattgtgcttctgcatttcatgtaactattgtagaatttgttttagttttatgagggaataattgttccaacttctatataactcaggaatttactctcaaacaacactgtcaattagttacttatctctctggaaatgatctgggaacatggagaggaaagggaggaaggggcaaaatctgaccacttaaatctaagcatattagatcattttatgctagaaagtcctgaatgatgtgactttcgttcttgtaaaacacctctttccatagattcatggcccaaacagtatataaagagtggggaaggaactgcatttgcaaatagttcaaatcattgctccatcttaactacgcagttcacaaagtgtgaagaaatgtgatcatctcaaaaaagataatggggaaaaaatatgttttgttctgtgactttaaagtcttgcaatattttacataaatgataatgggtgctttaataagaactcttgatacttttgttattgtattcaatatatgcatataatacaacaggatgatattgttttggatttggaaatgtattctttcttatgcaatcttatgcagtcatactgcttgaatatcattacctgaatttatctttcttttttttgttgttgttttacactctacttatttggtgcctgtcagtcttttgtcgtcagtttatattctactaaactcaaaaagacaatctcataccttttgtaattgtaggcattctttactagatttttaaatacacttcaaaaattcaagtactttgatttcatgccatcaagtagctgaatctatccccccgtctctttttaaatttaagtgagtagttcaatttctgtcactttctactttgtgaattctaaatcttttaaaaccatcttgccatttttcgtgcacttacccttacagaaaactctgtgaaacactacttatctctacttttatgtttttaactccttttttatattactattccctctgctttctaaatgcacatattaatttgttctttttattctctgtagctcttctcagtgtatgaattcagtttcccatcagtctccatacaattaaaaaaaagttgagtattctgttattttaataagatatctagtgcccatattctaattctgccccttatttttaatataattttattgttgatttaaaatgacaacagtttcaattcccagaaagtgaaaggaaacaaaggaataatattataggcttaatttttatcagtgaacttgt

SEQ ID NO: 28582 - DNA, 2238 bp, Homo sapiens
gcactgcgggtgctctctggcccccaccccatcatcgcgcaacacacccccttcaacatgcgcggccaccctttcattgccctgcgccccgagcggtcccaccgcccggcaaaacactgagcaagccgctgctctcaccttgcttgacacacttgagccggagggggtccttgcagtgtttgatcacggccagcacgtccctgatggtgagccccgccacgggggtctcgttcacctccagcagcagctcctccgacaccaatttgctgccgctctcataggccaccttgccgggcttcacctcccccagtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatgtggtttccagcattcctcacccagtccagggacactgtgggtgtgcccagcttaagtccagtaactggaaatacaagcccaagttctggagagtttgagctgcagagatatatatgggaacactttgaatcttgactcattggccataaccagcagagtggaaaatacaagaagagaaaaaaacattgaactgcgattttataacatcctttactaggcagagagaagaggaaacaccaggaaagaaaactgtattacgatgtgaaaacttaatgttgagaaattcaggcatcttggggttagtgaggagaagttttaggggcttagattcttctaaacacatgtacagaaatgcatatttcatctgatatcaaatggcatttatagtgctaatctttacctcaagacttcacatcttttggtgattgcatcttttaggtttatagcagctaagtttgcatgaaaacaccagggctgtttcatttcagtcaagaattaatgttcattgattgtgcttctgcatttcatgtaactattgtagaatttgttttagttttatgagggaataattgttccaacttctatataactcaggaatttactctcaaacaacactgtcaattagttacttatctctctggaaatgatctgggaacatggagaggaaagggaggaaggggcaaaatctgaccacttaaatctaagcatattagatcattttatgctagaaagtcctgaatgatgtgactttcgttcttgtaaaacacctctttccatagattcatggcccaaacagtatataaagagtggggaaggaactgcatttgcaaatagttcaaatcattgctccatcttaactacgcagttcacaaagtgtgaagaaatgtgatcatctcaaaaaagataatggggaaaaaatatgttttgttctgtgactttaaagtcttgcaatattttacataaatgataatgggtgctttaataagaactcttgatacttttgttattgtattcaatatatgcatataatacaacaggatgatattgttttggatttggaaatgtattctttcttatgcaatcttatgcagtcatactgcttgaatatcattacctgaatttatctttcttttttttgttgttgttttacactctacttatttggtgcctgtcagtcttttgtcgtcagtttatattctactaaactcaaaaagacaatctcataccttttgtaattgtaggcattctttactagatttttaaatacacttcaaaaattcaagtactttgatttcatgccatcaagtagctgaatctatccccccgtctctttttaaatttaagtgagtagttcaatttctgtcactttctactttgtgaattctaaatcttttaaaaccatcttgccatttttcgtgcacttacccttacagaaaactctgtgaaacactacttatctctacttttatgtttttaactccttttttatattactattccctctgctttctaaatgcacatattaatttgttctttttattctctgtagctcttctcagtgtatgaattcagtttcccatcagtctccatacaattaaaaaaaagttgagtattctgttattttaataagatatctagtgcccatattctaattctgccccttatttttaatataattttattgttgatttaaaatgacaacagtttcaattcccagaaagtgaaaggaaacaaaggaataatattataggcttaatttttatcagtgaacttgt

SEQ ID NO: 28583 - DNA, 1089 bp, Homo sapiens
acaattttaagatcttaaaagtcttctatcaaatactgaattttagatgttaaggctagtagagctgtacaaaaaacaacagcttcttgtatgaatgttcctcagtttaaatatttagtgttctattatcagtatgtgggcattaaaaaaacaagtcatttgaaactgatagagataattaagaaattcttagattttgggtataggtgctgcaacttagaatttaagtgtcgtccaaaagagattagtattggtcataacatggactctaaagccaccatttaaatgaagcatgtaaaaaagaatattctagtacacaaaaattattaatggcctagaatgacctccttctcactcatatgatgcaaagaataaagtatataaaaatgtttgttacaatggctatccataaaaaagaaaaccctccaaaacagcaaaattgaataggtatccacagtcaactttatcctgaaaattgcctagaaatactggttgtgattacacagcatcctgagaccaatgaatctttagacagtaataatttcctactctaaagctattctctacttcctccttagtgacagagctccttgctgctcaaattttatgccagataaaatattcaccttctcggactccctggcaccaggcatggccatgtaatcctacagcacagctgatgaaagagaagacatcttgctgctatttgacaagcaagaagataaaagctttcctataaagatgatggagcaaaaaaatagaaggggcctagactccctaccttcacacttcctgctataaaagcattgctattataaggttaatctgcagaaacagacttctatgtcatatgcttaaatgcatcaaaattcatacaatatccattaaattggtaaaagtatccattttaaaggattaatctgagggacccacagacacttaacacaatcaaatctcagaaaaaaaatcagttatttcattgtgattttgaggctgatcttttatgatcttttagttatcaaactgttaaatacattttaactttcaaattttatgaataaaggagatgaatcctgttaaaaaatcagt

SEQ ID NO: 28584 - DNA, 483 bp, Homo sapiens
  misc_feature (25)..(27): n is a, c, g, or t
  misc_feature (43)..(44): n is a, c, g, or t
gaagttataatgtgtaaggagggannncaagcagagatcaacnntttactcacagacccctacagcacagctgatgaaagagaagacatcttgctgctatttgacaagcaagaagataaaagctttcctataaagatgatggagcaaaaaaatagaaggggcctagactccctaccttcacacttcctgctataaaagcattgctattataaggttaatctgcagaaacagacttctatgtcatatgcttaaatgcatcaaaattcatacaatatccattaaattggtaaaagtatccattttaaaggattaatctgagggacccacagacacttaacacaatcaaatctcagaaaaaaaatcagttatttcattgtgattttgaggctgatcttttatgatcttttagttatcaaactgttaaatacattttaactttcaaattttatgaataaaggagatgaatcctgttaaaaaatcagt

SEQ ID NO: 28585 - DNA, 2307 bp, Homo sapiens
gcactgcgggtgctctctggcccccaccccatcatcgcgcaacacacccccttcaacatgcgcggccaccctttcattgccctgcgccccgagcggtcccaccgcccggcaaaacactgagcaagccgctgctctcaccttgcttgacacacttgagccggagggggtccttgcagtgtttgatcacggccagcacgtccctgatggtgagccccgccacgggggtctcgttcacctccagcagcagctcctccgacaccaatttgctgccgctctcataggccaccttgccgggcttcacctcccccagcagaggaagcagtggtggtggcgtcggcggcggcggcggcggcagccggagcgagcagtagccgagctgtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatgtggtttccagcattcctcacccagtccagggacactgtgggtgtgcccagcttaagtccagtaactggaaatacaagcccaagttctggagagtttgagctgcagagatatatatgggaacactttgaatcttgactcattggccataaccagcagagtggaaaatacaagaagagaaaaaaacattgaactgcgattttataacatcctttactaggcagagagaagaggaaacaccaggaaagaaaactgtattacgatgtgaaaacttaatgttgagaaattcaggcatcttggggttagtgaggagaagttttaggggcttagattcttctaaacacatgtacagaaatgcatatttcatctgatatcaaatggcatttatagtgctaatctttacctcaagacttcacatcttttggtgattgcatcttttaggtttatagcagctaagtttgcatgaaaacaccagggctgtttcatttcagtcaagaattaatgttcattgattgtgcttctgcatttcatgtaactattgtagaatttgttttagttttatgagggaataattgttccaacttctatataactcaggaatttactctcaaacaacactgtcaattagttacttatctctctggaaatgatctgggaacatggagaggaaagggaggaaggggcaaaatctgaccacttaaatctaagcatattagatcattttatgctagaaagtcctgaatgatgtgactttcgttcttgtaaaacacctctttccatagattcatggcccaaacagtatataaagagtggggaaggaactgcatttgcaaatagttcaaatcattgctccatcttaactacgcagttcacaaagtgtgaagaaatgtgatcatctcaaaaaagataatggggaaaaaatatgttttgttctgtgactttaaagtcttgcaatattttacataaatgataatgggtgctttaataagaactcttgatacttttgttattgtattcaatatatgcatataatacaacaggatgatattgttttggatttggaaatgtattctttcttatgcaatcttatgcagtcatactgcttgaatatcattacctgaatttatctttcttttttttgttgttgttttacactctacttatttggtgcctgtcagtcttttgtcgtcagtttatattctactaaactcaaaaagacaatctcataccttttgtaattgtaggcattctttactagatttttaaatacacttcaaaaattcaagtactttgatttcatgccatcaagtagctgaatctatccccccgtctctttttaaatttaagtgagtagttcaatttctgtcactttctactttgtgaattctaaatcttttaaaaccatcttgccatttttcgtgcacttacccttacagaaaactctgtgaaacactacttatctctacttttatgtttttaactccttttttatattactattccctctgctttctaaatgcacatattaatttgttctttttattctctgtagctcttctcagtgtatgaattcagtttcccatcagtctccatacaattaaaaaaaagttgagtattctgttattttaataagatatctagtgcccatattctaattctgccccttatttttaatataattttattgttgatttaaaatgacaacagtttcaattcccagaaagtgaaaggaaacaaaggaataatattataggcttaatttttatcagtgaacttgt

SEQ ID NO: 28586 - DNA, 985 bp, Homo sapiens
gaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtttgcatccaagagaggggaggacaggggcaaaaggatgcagggaggctgctgatttccactgaagagctaatttcctgtgagacattaacagtgatttaagaaaaagattcctgtaactgtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatgcctacagcacagctgatgaaagagaagacatcttgctgctatttgacaagcaagaagataaaagctttcctataaagatgatggagcaaaaaaatagaaggggcctagactccctaccttcacacttcctgctataaaagcattgctattataaggttaatctgcagaaacagacttctatgtcatatgcttaaatgcatcaaaattcatacaatatccattaaattggtaaaagtatccattttaaaggattaatctgagggacccacagacacttaacacaatcaaatctcagaaaaaaaatcagttatttcattgtgattttgaggctgatcttttatgatcttttagttatcaaactgttaaatacattttaactttcaaattttatgaataaaggagatgaatcctgttaaaaaatcagt

SEQ ID NO: 28587 - DNA, 2335 bp, Homo sapiens
gaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtttgcatccaagagaggggaggacaggggcaaaaggatgcagggaggctgctgatttccactgaagagctaatttcctgtgagacattaacagtgatttaagaaaaagattcctgtaactgtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatgtggtttccagcattcctcacccagtccagggacactgtgggtgtgcccagcttaagtccagtaactggaaatacaagcccaagttctggagagtttgagctgcagagatatatatgggaacactttgaatcttgactcattggccataaccagcagagtggaaaatacaagaagagaaaaaaacattgaactgcgattttataacatcctttactaggcagagagaagaggaaacaccaggaaagaaaactgtattacgatgtgaaaacttaatgttgagaaattcaggcatcttggggttagtgaggagaagttttaggggcttagattcttctaaacacatgtacagaaatgcatatttcatctgatatcaaatggcatttatagtgctaatctttacctcaagacttcacatcttttggtgattgcatcttttaggtttatagcagctaagtttgcatgaaaacaccagggctgtttcatttcagtcaagaattaatgttcattgattgtgcttctgcatttcatgtaactattgtagaatttgttttagttttatgagggaataattgttccaacttctatataactcaggaatttactctcaaacaacactgtcaattagttacttatctctctggaaatgatctgggaacatggagaggaaagggaggaaggggcaaaatctgaccacttaaatctaagcatattagatcattttatgctagaaagtcctgaatgatgtgactttcgttcttgtaaaacacctctttccatagattcatggcccaaacagtatataaagagtggggaaggaactgcatttgcaaatagttcaaatcattgctccatcttaactacgcagttcacaaagtgtgaagaaatgtgatcatctcaaaaaagataatggggaaaaaatatgttttgttctgtgactttaaagtcttgcaatattttacataaatgataatgggtgctttaataagaactcttgatacttttgttattgtattcaatatatgcatataatacaacaggatgatattgttttggatttggaaatgtattctttcttatgcaatcttatgcagtcatactgcttgaatatcattacctgaatttatctttcttttttttgttgttgttttacactctacttatttggtgcctgtcagtcttttgtcgtcagtttatattctactaaactcaaaaagacaatctcataccttttgtaattgtaggcattctttactagatttttaaatacacttcaaaaattcaagtactttgatttcatgccatcaagtagctgaatctatccccccgtctctttttaaatttaagtgagtagttcaatttctgtcactttctactttgtgaattctaaatcttttaaaaccatcttgccatttttcgtgcacttacccttacagaaaactctgtgaaacactacttatctctacttttatgtttttaactccttttttatattactattccctctgctttctaaatgcacatattaatttgttctttttattctctgtagctcttctcagtgtatgaattcagtttcccatcagtctccatacaattaaaaaaaagttgagtattctgttattttaataagatatctagtgcccatattctaattctgccccttatttttaatataattttattgttgatttaaaatgacaacagtttcaattcccagaaagtgaaaggaaacaaaggaataatattataggcttaatttttatcagtgaacttgt

SEQ ID NO: 28588 - DNA, 957 bp, Homo sapiens
gcactgcgggtgctctctggcccccaccccatcatcgcgcaacacacccccttcaacatgcgcggccaccctttcattgccctgcgccccgagcggtcccaccgcccggcaaaacactgagcaagccgctgctctcaccttgcttgacacacttgagccggagggggtccttgcagtgtttgatcacggccagcacgtccctgatggtgagccccgccacgggggtctcgttcacctccagcagcagctcctccgacaccaatttgctgccgctctcataggccaccttgccgggcttcacctcccccagcagaggaagcagtggtggtggcgtcggcggcggcggcggcggcagccggagcgagcagtagccgagctgtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatgcctacagcacagctgatgaaagagaagacatcttgctgctatttgacaagcaagaagataaaagctttcctataaagatgatggagcaaaaaaatagaaggggcctagactccctaccttcacacttcctgctataaaagcattgctattataaggttaatctgcagaaacagacttctatgtcatatgcttaaatgcatcaaaattcatacaatatccattaaattggtaaaagtatccattttaaaggattaatctgagggacccacagacacttaacacaatcaaatctcagaaaaaaaatcagttatttcattgtgattttgaggctgatcttttatgatcttttagttatcaaactgttaaatacattttaactttcaaattttatgaataaaggagatgaatcctgttaaaaaatcagt

SEQ ID NO: 28589 - DNA, 1071 bp, Homo sapiens
gaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtttgcatccaagagaggggaggacaggggcaaaaggatgcagggaggctgctgatttccactgaagagctaatttcctgtgagacattaacagtgatttaagaaaaagattcctgtaactgtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatgtgacagagctccttgctgctcaaattttatgccagataaaatattcaccttctcggactccctggcaccaggcatggccatgtaatcctacagcacagctgatgaaagagaagacatcttgctgctatttgacaagcaagaagataaaagctttcctataaagatgatggagcaaaaaaatagaaggggcctagactccctaccttcacacttcctgctataaaagcattgctattataaggttaatctgcagaaacagacttctatgtcatatgcttaaatgcatcaaaattcatacaatatccattaaattggtaaaagtatccattttaaaggattaatctgagggacccacagacacttaacacaatcaaatctcagaaaaaaaatcagttatttcattgtgattttgaggctgatcttttatgatcttttagttatcaaactgttaaatacattttaactttcaaattttatgaataaaggagatgaatcctgttaaaaaatcagt

SEQ ID NO: 28590 - DNA, 428 bp, Homo sapiens
taggctggtcttgaactccttgcctcaagtgatcctccttccttggcctcccaaagtgctgagattataggcatgagcaactgtgcccagcctctaattaagtatcaggtttttttaaagctaatatttgttgagtcattatgttccatcaggcattgttctaagtgttttaccaatattaatttatttaatcttcactgtaactctgtaaagtagctactgttattataaatgagtaaactgaggcatagttaagtaacatgcttacaactgcaaagtagcagggacaagatttgaattcaaggccgggcacagtggctcaaacctgtaatcctagcgctttgggagactgaggcgggaggatcacttgagcacaagagtttgagactaacctgggcaaaacagtgagaccttgtctctaaaaagaa

SEQ ID NO: 28591 - DNA, 459 bp, Homo sapiens
caaatgaatgcacagcatgagatatttaaaatagtatcatatactttaggatcaaacaagcaaaaaatactctgatatagtatgtgctacataagcgtttttgttacgtgctaggcctctcaaaatggatttgtagaaaatgacacagaatcacagttcatgccctagtttacggtgctctttttgacccgtgttttggaagagtgatagttatcctactgtaaatagctttcctattacaaatagtagttaacatgtcgtgtataaatttctggttttccacaaatatctatgaccacaaatcgagaaagtaatgagttgtgaccaatagttaatatattttctaaatttaaatgtactaccgccacaaataactgcgttttggattattaaactatccacagtaatttaaagtgaatcatcctcttcatttatagctaaattctctaggccaaaaga

SEQ ID NO: 28592 - DNA, 285 bp, Homo sapiens
atgacatagttattattatccctgttttacagatgaggaaacaaagagagattacataatgtacccaaggtcaaagatttagtaagcatcagaaccaagacttgaacccccatttgtttgattctagaatctattagggttttcagtttaatcccaagtatttcaccttacataatatagtaagtagaaaaagaaattttttactattgctataactattattaaaaacaacccaaattttatgaacttcttgagcttttcattgctaatattagaccaaaaaaa

SEQ ID NO: 28593 - DNA, 459 bp, Homo sapiens
aagtggaaattctgtgtcaaagggaatgattgtgacgctattgatactgatatgtgctttaacatcaagatgcaaagtgtacatttctcccctcccacacttaacactagccatcattgatttctctgatattagtaaatatatttgttctaatgcacgttctttgacacaccttcatttatccttttctgtctttggactgaaaagttaaatctattgatcctttttctattttatgtaatataagcaatttctcccaggttgtcttgcttttcactatataaaagcatttcatcctcatgtaatcaaatgtatctgtacttttctttgtgattttgcctttaatgttattctcagaaagtccttcttaccccaagattttaaacatattcaccaaaatttctgttttgaatttattttcttcatttaaataaaatgtctgccctgaatttactttgt

SEQ ID NO: 28594 - DNA, 484 bp, Homo sapiens
ccaagaggaaccagggacagttcgggtaaaaatgggcttgggaagcaaacggactatcgtttaagggatgagcatacagataagtgatcccaaaagaacatacaaagctgatctcaagggcgaggaacctcgtagatgccagtggatcatcattactccaaatttcaaacccaagccccaagacttggggtttctatttgaacacattctgagcaggttattggcacagactcaagggtcaatcatggcagggggcagctaatcagatgtttgttcccaggcctctacaaccagtcatgggaagactgaggcttaagtgctgtattagtccgttctcataccgctataacgaaatgaatgaggctgggtcgtttataaagaaaagaggtttaattggctcatggttctgcaggctgtaaaggaagcatagcagcatctgcttctggggaggcctcagggaacttacaatcatggcagacggcaa

SEQ ID NO: 28595 - DNA, 465 bp, Homo sapiens
aacactctttatccaggagatgaatacatgggcatttattttactaatatctaaattataccatatttctatgctgccttctatctgtatgacacatcttacaatttaaaaaattaagtataggcagtaaacagacaggcccacaagaataagaacaaagaacaggtgaatattggccaggcgcaatggctcatgcctgtaatcccagcactttgggaggctgaggcgatcactcgagcccaggagtttgagatcagtctgggcaagatggtgggaccctgtctctactgaaaataaaaattaaaaaaaaaattagctgagtgtggtggtgtgtgcctgtggtaccagctacttgggaggctgaggtgggagagttgcttgagcctgagagttcggggctgcagtgagctgtggttgtgccactacattccagcctgcgtgacagagagagaccatgtctcaaaa

SEQ ID NO: 28596 - DNA, 848 bp, Homo sapiens
gacctctcacttgctatctccattgatggccaggaaggcagggaggttcttcgtgccatcccttctcttccccctaccttccaccagacacttcccgattccatgctgagcagcccatggcttccagcagccaaagctttaccccctccccccacccactctggactggactgacagatgctaggcctacttacgtttcctgcttgtgccttcccacacaggggacagcggtgtgggtccaagtgcaggtgatattgcccaggcaccagcacagagacacacagatgggcctgccggggagctcctgtgctcaggaaaacagagcccaaaagggtgggcactgagctgccagttaggactcagacacaaggtcagatacttcctcctgtggtgctgcagctggaaatttcggccatggctccagagcagtgtcagaaagggattggtaacaaacagaaaatgcagcctgtatgtgtgggtactttggggatgaacagccagttagaataaatgaaaatctcacatcactcgctagctttcaatcctttgacagttgcccatcgggtttaggatggaactaaatctcttgacgtggtttgcaagaccctgcatggcctggcccttgcctttccctttagcctcctcttcttccccagctgcactgcaccattcctctgtctgatcctcccaccggccatgtttcctcctggcccagagtgttcacagacactattccatcttccggattccgccattcacctggtgttctgggtaacgtcggtcatgagagcagggactttgcatgctcttccttggttatatccccagtgccaaaaagacagccttgc

SEQ ID NO: 28597 - DNA, 431 bp, Homo sapiens
attactaaattagcggccggtcggattggtaacaaacagaaaatgcagcctgtatgtgtgggtactttggggatgaacagccagttagaataaatgaaaatctcacatcactcgctagctttcaatcctttgacagttgcccatcgggtttaggatggaactaaatctcttgacgtggtttgcaagaccctgcatggcctggcccttgcctttccctttagcctcctcttcttccccagctgcactgcaccattcctctgtctgatcctcccaccggccatgtttcctcctggcccagagtgttcacagacactattccatcttccggattccgccattcacctggtgttctgggtaacgtcggtcatgagagcagggactttgcatgctcttccttggttatatccccagtgccaaaaagacagccttgc

SEQ ID NO: 28598 - DNA, 376 bp, Homo sapiens
atctgtcaaaccaccatatgggtctgtaatagtataaagttctctgaattttctgttcttgcaatttaagctttttcactagtacgcttactcccgaagctagactgccttcaagagagctgtgctgaggatatttcaaactgttttatacacacacacacagcctgagtgagatgaatgggttaggtcacttgaaaaacttttaagggaattagaatacaatctctggtatgggactttcattttatagcccaatgaggttattgctctagctctattacatctaacaccaaaaacctcagtgagcagacatggtttttacttcattaagtaggctttttaaaaatggactttctaccttctgagccaaaaaaaa

SEQ ID NO: 28599 - DNA, 462 bp, Homo sapiens
gcaataatagtatctacctcatagaagaaaccccaattaagtgtggtttaagccagtcaggattattttcctcccgtaacaagaaatctgtgagtgagtggttgttggcattgtttcagcgctgcacgaggccaacaggaacccatgccgttcctaacattctgctctgtcttcctcagtatgctgcctcttcagcctcatgcttagagcctctgacggcaagatggctgctgcagctccaaatagcatagtcatatcataccttatttttcctctaatatcagggaaaaggccctgctattcctcctgtgcaccctgctagcaaatttctttgtaggtctcattggctaaatctgggtcacattttaatctctagctgcaaaggatgctgagaaaaccagcagaagattatcttgattggctcaaatcatgaccgtcacctaggaccagtcacatttgcct

SEQ ID NO: 28600 - DNA, 506 bp, Homo sapiens
attaaacagcctaataatggtttggcaacttgcttttctctttcaagtctttaatcttttattcagaggatgctttgttttctgggaagcaccaggataatgtggcaatgctttaaaaaaaaaaaaaaaactggctttacttcagcaagctttcctgggagactctaatggcagagactgttgaaatagaaatgcctcatgaacactggccgccccatagtgtctcacttccctctttccagccagtgattaacagctcttaatgaattcagaggactgcatggctagattctggggttactggtgcaggctgatggagaaggggttgaactgcattaaataaacaaaacaaaatagtgctccagaaaaagcacggggccgggtgcaatggctcatgcctgcaatcccagcacattgggaggctgaggcagggagattgcttgagccaggagtttgagagtagcctagccaacataacgagaccccgtctctatataaaaaaaaaa

SEQ ID NO: 28601 - DNA, 363 bp, Homo sapiens
gactaatttcttctgccttcagttcactcttctgtaaatgggaaataaaaattcctacctcatcagggttaacttaataaaacaacccatatatggctgatagcacagtgcctggcacataataatctgtcaggaaacattagttttttatagtatttttttattactatcattgctactgcaatcaagatcatctttggtccatccagagcacgaactcacttaaggttgaaaggttcatacacggctgaatgtgtgtggctcacacctgtaaccctagcactttgggaggctgaggtgggaacattacttgagctcaggagttcaagaccagcctgggcaatatagtgagacctcatctct

SEQ ID NO: 28602 - DNA, 677 bp, Homo sapiens
acccaaaggctgacgttagctgcacctgtaacacaactttttcctcaaatgtatggagatttttttaggcttccacttctatacttgcctattctcactccctgttttaatttaacatacacatgcaatgctagataatagaattgctctctatcagctgaacaggggggagcctgtgcagtttctcacccttcttgttgcacatggataaatacatcgggttttatagagactcagctgtaaaaatcatgaaatgtgctgcctggttaaaatgactagactcttctggcttcttccttgatctatcctattgcagttggtttgcatcttgcctaaggtgcatattccaaactcttgatattttcctcctgatagtcatactggtagtctccctcgtgtggtgcaatctacagatgtttttattggtgtgcagccattcttcaaatatcaaatggtttctcttgggctggaattacaaaaactcaaagaaatgtgtgatttatgggctgggcgctgtggctcacatctgtaatcccagcattttgggaggacaaggcaggcagatcacaaggtccaggagtttgagatcagcctgggtcaatatggtgaaaccctgtctctactaaaaatacaaaaattagcagggcatggtggcgcgcacctgtagtcctgtaggg

SEQ ID NO: 28603 - DNA, 472 bp, Homo sapiens
tcttttttctagactaggatggcaaatacaagacactaatgctgctccccttcccttccaatactatgaaatcctctctaaaaatatcctcaaaatctttcttggtatagtgccctaggcagccattactaacgctgattggaattgactccgaaggtaaaacctatttggcacttttgctctaggcagtgttcaatttttttgtcagttttgtttagtttttggggtgttcctatgcctgagtgggattcttcttttggaaattggaaatagttgcatagtggtttttaacatgaattaaataggtgataattcacagagccccctttcccaacaaaataaacaaaaggtaggttagacggactattgggattaggatgttgttttaagctaggaggtggcagaccgcacaacctatgggccaaatccatcttggagctaagaatgatttttatatttttagatggtagca

SEQ ID NO: 28604 - DNA, 407 bp, Homo sapiens
atgatgactacagggccataccagggctttcaagaatgcagaagtgaggctgagccacagattccacggtggaaagcagctctattgaatttgtacacctcccattccaaatagctagcttaaaacacagcagctgccattttccttcaaaggagaaatacaggaaagacctaagggtccaaaactgggtaaaggcacttccaggaaaccagaaggagaagaggattgcttaagccgctgctggctcctctttccatcctggtaagcatttacaatcagagagggaatgaataaacgcagagggccaccaggcatggagtgcatccaacagccctggccactgggccccactgaggaaggatccagccccatactgcatggtgagacccttgcaagagcacagcttc

SEQ ID NO: 28605 - DNA, 422 bp, Homo sapiens
ctttcttgcttttatttttaaactttttaacctaaggggttggagatgggacaacttctctctcgtaggatgaaggacgcatgttaatcacagcctgccttttgcccgctcttgctccagaaaaaacaaaacaaggatctgttagctctttaaaagaagaaaaacacactaaaaaaatgcagcattgttgtgtagcctggtagggtattgctagaaaccaggctggctgttcttcctttacttcctcttctagctaattcttcaataaagtacttaagacagcccttaccagcttgacatctttatttcaaaaggagaggaggggttggctgttgttttcctctgagcctggccctacccttctcttggagggggagaaagagaaacccaaagcaaaggaaaaagagagagagagaaaaaaa

SEQ ID NO: 28606 - DNA, 351 bp, Homo sapiens
tgagacggagtatcgctcagtcacccaggctggagggcagtggcacgatctcagctcactgcaacctccgcctcccgggttcgagcaattctcctgcctcagcctcctgagtagctgagactacaggtgcctgccaccacgccgggctaatttttgtatttttagtagagatgggttttcaccatgttagtcaggctggtctcgaactcctaacctcaggtgatccgctaacctcagcctcccaaagtgctgagattacaggagacagcgttttaagaagcggcctatgtcagcgcgtgtatctttttgaatgggaaagcaaagcacactattcattctggacagccccca

SEQ ID NO: 28607 - DNA, 486 bp, Homo sapiens
tgagccattaataaacttaggattgttagtattctaaagacatttttataatttgaaagaaagtaaaacattctttttggcaatctaaactatgttacccacatttaaacaaaaacaattggaaaatacttataaatatgtatttatatgggaatactatcatggtaagtagatgaaacatatttcaaaaccaatagtgctagttctgtaactttgccgtgtctgggtcccaacaattattgcagttatttaagagtatatgtgaagattatgtcaatttaagtaaaactgagacctcttcattagtcggcgttatatatgttaacaaaaacattcttctcttccaacaaggggtaatagtggaggcttctaccctgctccaacctaactttatttctctctgtgttctctactattcattgattgaatggtcttggcagattatttaacttcagagctgcaatatctttatttatagaatattat

SEQ ID NO: 28608 - DNA, 251 bp, Homo sapiens
aactacccttgcaaaagatgcaacatgcagataactacaattaggttctaagaggtcttgtgaaaataaaatgattcctattttgttcagactttgatggaacagaaaacagaaaactatcaattcgttttttcaaggtgtaactttgttattcaaacagggcaaagatacacacacacccccccacaaaaccctagagactggtctcacttaagactagacgtatagaaatattatgtaaatctttagca

SEQ ID NO: 28609 - DNA, 603 bp, Homo sapiens
cgtcgggtgcctgattaaaatgcctactggaaatcagatgtccatgagttcaaggtcatggccttagacttggctgttgtaagggcaaatacaaattagaaataccagacttaaattatgaaacttgaagataaaaaaagacattttactctccttttaaaaaataatttaagaaaacttttatatgtaaatttattttgtgtctctattaaatgtatgtacatcatttaaataggtaaataggactttgtcagcctttttaacttagaaatgtctttctctaggacctggaaaccattgcattgaaatgtaaatggattacctttctgtcctacagtaggtaacttcataaaatattatgaagccaaggaaatcttattttgcttttgaatatagccaatttaaattttcattgaatatacccaatatacatataggcttctcaattacccggttaatttaagatgaactatatatgacaaattatgctgttaagtcttctacttaaagactaaatatggtgatttttatctctgcttttgtaatctcagcagattgcctatgatgggtatcacattgtggtttaattatgtaaaaaaaaaa

SEQ ID NO: 28610 - DNA, 418 bp, Homo sapiens
agttcagtgagaacctctgtactccatgggcattttctaggaaataatttcacctgccctgtgtaattctctggaagaatcacagtgagttggaaggaaacttaagacttggaaaaggattgagaggttagcccagaccacaccagggctctgaaggcccagctggggttagaacctgggacaccctccagcccactgtctcctgttccctggccatttactgccccactcccctttctactctcaggggccctggatctaatgaggggattcgtgcagtttgctgcactaatacattgcaagtggtgccaacctaaaggtattctgatggtggaatcagagcagtagcatcttattaggtcagaatctgtatctcctcttccaagatttttacatgatttagtgttttctgaattgg

SEQ ID NO: 28611 - DNA, 205 bp, Homo sapiens
tctcgtgtgtgtggcgcttagaagattctgaaattaacagactggactgaatattttcattttagtcctaaatttagattttcttagtactttgaaaatcttttcttgttagaagtatcctctacaccacttttttggtttgttttcctgatctttttttttaaaggaaagtgcatatatgtagttagggctcagatagcagtct

SEQ ID NO: 28612 - DNA, 502 bp, Homo sapiens
aaaagggtgtgtggaatcgatttaagtttaacctgacagtacatgtcttgaaggtcttttatgaacttgaaacacatcggctaggtcttcatcctcacctgcactggaattacctacttaagaaaaacaaactaatgatacacaaagaagcacttataaattacatatcttcatgccggaaacactatttggatgcgtgtggatgattctgaaaattgatatagtctgaaggatgtatatgtacatttatatatagacaaaatataacccaattgatattccattgaagctttgtattcatttcatcagattatcgtgtacctaaattatgtgtggaaatttatacttagtagattctcaaatattattggctaaactgcatttcacaggaaatgtatttctcaggagtgttttctcattgttttccttaaaaaacaatgctggcacccagcaaaataataaaattaaaaaataaaataaaatgcaaatactgcctaaggga

SEQ ID NO: 28613 - DNA, 701 bp, Homo sapiens
gctctagaggattcacggtatgagtggccatgtgaacaactgtgagtagaaacatggccagtgcagattaaagagctgaagacagaaattactgctaatgataggagtattacttcatttattccagtgacaatttgcattttgaatgacctactggacgtgcagtttagggaaaaggattgaaacacaactaatgtgaccgactacctaatgtaactgagtggcatgtaatggtacattcaccactattaggaatgaggaaagagaagcaaccctgaaggctaaagggtcagttttatacatgcctttatgtaagtaactatgttcatcacatggccaggaggcagccataaaatatagtagacctcaggggagctagcagtcagtgtaccaagtaagagtgtgtggccagagctaggcagagacaactggtgtcttgaagaaaagcagagcagccaatctctaggcttggtttctgaggactgtcccaggcctgttccagctccacaattatatcctcagaacaaaacctctttttgagttagcatgagtaatctctctgttccttgtgaaaaactgatagaaaaagcaaaataaaagaatctccctacaagtatctgtatctttggttcaattattccattcataagaatttagcctaaaaaaagaataaaaaatgaaacttctgtataaacagcaaa

SEQ ID NO: 28614 - DNA, 434 bp, Homo sapiens
gcctatgcatttcatgacgttacgcacctctgttaagtggaatcatgtagtagttgtctttttgagtctgattatttcacttagcagaaagaactcaaggcttaatcatgttgaagcacacatcagaatcacccttcttgttacagctgaatcccatttgtttgtacgcatagaccactttttgtttattcattcatggatggatggacactgggcttgtttccaacttttagctattgtgaataatgctgctatgaacaaagacatgcaaatatctgctggggcccctgctttccgttctttttggaatacaccagaagccgaattgctgcatcttgtggtaagtctatgattaattttttgagaaatgaccacagttgttgtgccatattacaaacccacaaacactacacaagcattccaattcctcctcg

SEQ ID NO: 28615 - DNA, 377 bp, Homo sapiens
atttataagttaaactttatcataggtatatatgtatagaaaaaacatagtgtatactgtatggggttcagtattagctgtggtttcaggcatcctctgtagaggtcttggaatatatcccttgtggataatggaggactacatatttgactggttggtggagttaacctaaggagaccttttcatgactctttaaacttttaggtttaaaggttgactcggaaaagaaaaacaatttatatcaataaatctaaggtaggcttatatgaatgctgcatacttttcatcactgcagtgttgtggaatgaaaagtaattgtatggattttatactatacaacattaaactcatagttatttggaatatgagcaaccagg

SEQ ID NO: 28616 - DNA, 605 bp, Homo sapiens
taaaaacatttgacgatgtatataatacatttgttttttcagagcatcttcttgcaagactttactattctttgtttctatatagtttggaaacgcaggcctaaagacattattgatcttctcaaatgcctcttgaatggagtatttaccgctgggtatagacagtgttaaaaataggcagaggccgggcgtggtggctcatgcttgtaatcccagcactttgggaggctgaggcggaaagatcacgaggtcaagaggttgagatcatcctggccaatgtggtaaaaccccatctctactaaaaatacaaaaattagctgggcgtggtggcacatgcctgtagtcccagttactcgggaggctgaggcaggagaatcgcttgaacctgggaggcggaggttgcagtgagccgatatcgtgccactgcactccagcctggtgacagagcaagtctccatctcaggggaaaaaaaaaaataggcagaggccaggcacagtggctcatacctataatctcagcactgtgggaggccaaggtgggaggatgacttgaaggcaggagtttgagacaagcctgggcaacatagcaggactccatctctatt

SEQ ID NO: 28617 - DNA, 264 bp, Homo sapiens
ggacgactgagtgaaaaaccttgcctctaaaatcaaaaaccaacttgagaatggtgacatgggcagagattttaaatgagtgatttatttttctccaacctgactgataggagcttttcttctaaggtataaggtatttactagagtgtgaagctatttatatgcaattatataatgcaaagaatataattttattagcttataattacaaaataaatacaacacattaggttgatcaaattaaatgttctgccttttttggcc

SEQ ID NO: 28618 - DNA, 387 bp, Homo sapiens
tgtgtgtgtgtaaagacagggtctcactttgtcacacaggctgatgtgttgtactgcagcctcaaacaactgggtaagtgatcctactacctcaaccttccaagtagctaggactacaggcaaactgagacaggagaaacacttgaacctgggaggcggaggttgcagtgagccaagatcgcgccactacactctaggttgggtgacagagtgagactccatctcaaaaacaaaaagaatatacaatgtagtgtaaatttctaacaaattctagaactgcaaaattcatctatatcaacaaaaagtagtgcagtggttacctgggcaagaggtaagttaagggttggagactcactgcaaaggggcacaggaaactgatagaaatgt

SEQ ID NO: 28619 - DNA, 538 bp, Homo sapiens
ctggggtcctggctttaagaaccagatgccaacactcccggacagtttatggcatccggatccctcaagggtgctcatctgcagttgagagtgttagtagcaattatttatctgtcctggagaggagttcctgaacataaatgtcctctgctggccctaaagctgggggcggaggctgtgtgttgtggggtgggggttggggggccgaatgttcccggtcctgttatctggtttagcagcatttgttgtggttttcgaggaaacggcatttggattacataaggattcaagtttttgctgtacttgtttatttaataccttggcaagagggagcccttaccctgaaaccagataaccgattttgggtttaaaacagccttagatgaagggccactcgaggggaagaaaatgagcaaagccacaaaaagcaaacaagggaatgtttatttttctctttttggatatttttgaagacctgcctaacctcttacacttcttgtcgcatacagctaataaatggcattaacaaagcgtttca

SEQ ID NO: 28620 - DNA, 396 bp, Homo sapiens
ataccagtacctatttttactcttacaaaatttcctgtaaaaaaatactacatttgaaattatttcattggttttagaactggcattgaaggtacccagtagactcttaagcctttactgcttgtctcactagaaacatttatttctgacctaccaagttttcttcacatcatcaaatttattcagcttctcagtgctgtaccgtatgatggcaagacatacttggtatttccatttttgttggtcattctttattgctttttactgctaggaaggtcttgccaggcttctatacagttacaaaaaccattaccaaactttatcaaggactttccaaatggagttttcaaatactattgaccacattgctctagttaatgtaaggtcagctctgac

SEQ ID NO: 28621 - DNA, 615 bp, Homo sapiens
gtgtggggcaatgacagcgaatactcatgaggggcaacaacttcagacaaaatctctgaagactcacccgtgtctccacacttcttccaccccttgctagctgtgtaaagttaaccactgtgactctcagtttcctcgtctgccaaacggagtaaataatagtgcctttctaggatggatgccaatgttgtttggattcaaacataaagcagatgcagagggtgtaacgcggtgcctgaatacatgaaagttaagcatgagctcttgggtttttgtttccccagatttcttctctcttggtggctctttaatgaatagtgacagtccatacccaggcagccatagccactgccactgccacagccaaagctcaggctatgtgatgaacctgttttctctgccttctgcccctgctcccagccatcccggcagaggtgcccacctcagggctcttaccggagcccctctcccaccgcttgaatgcagaggcgtttcttctgctgacagcctgaagacaggccatttttcttctcctcccatataatggcctttactctcctaccactccaccccctttcccagccttaatgactttaacatacacacagttattta

SEQ ID NO: 28622 - DNA, 445 bp, Homo sapiens
cctgatgtttgtataaaaaatatattatctcttacatataacatacaaaatctatgttaattgactttatattatcagtaaggcttctggtcagtagtaggctattagtagttgagttttgcgggagtcaaaaattatatacagatttttggttgcacaagggtttggcacccctaacccccgtgttgttcaaggttcaactgtagttaagaacagggctcttgaatcaaactcttaattcaagttcaggcccctgacatactgagtgactttggcaagttgcttttctaagtctcagtttccatatctgtaaaatgaggttaataacgttacttaatgaattgttagaattaatttaaatgctattcatacagttctgagctcagcacagtgagcatcgtgtaatgatagctaatgaatattgataataaagggtactatgatt

SEQ ID NO: 28623 - DNA, 1589 bp, Homo sapiens
aggcattaggaagccttctttagagttcaaaattttagaagcctaatttgctcttacttccttcaattatgtgccatgtgttttggtttgtatatgttttaaattgtatatttccttggaatatgcttgaaatatttaagaatacattttcaaaatgtataatactgtattgttttgttgatcagaataataagtctcagttaaatgtttgttattactgatagtcaaaatgctcaatagaaatgatgagaggcattggttccaattcattgtcaaatgaacgttttctaattttgttcacagattctttccctttcgattgttctgtatgttaagatagtggcttctgctctcactgttttcctatttatattactagcaggtaggagtgctaattagaaaaacttagatggtattgaaattacagttgacaacttatatttttatgagatggagaaaaaagattaagttgatataacaacaaagtggactttttttcttccttatcctgcacgaaatattgcccttgtttcctctactttcctcttggtgttttctctttttttcaaacagaaacaggccaattccattttcttgagcaagaaagcttagtgtgttacttcatcaaggccagctaatactgtgttaaaccgggctgaaaatgagaaaacttgggagatggaggaatggggaaatggcagtgggataggtagggaaggattactcttaattgttttaaaagccataggaaagtcttccttgtacgtggctgtaaatttataagaactattgtgtcacataaaccaacaagaatgaacctttgctgcttcagataatttgatttttccagcaaggaaattaataagttactgattcttcagcatagaaacaactgagaagaattaatgcaatgtttcttcactagaaaacccaacccttcatttcttttcattgctccaaaacccagttttcaactaatggttttctcattaaactaaatgtttagaaaagttgtttagagtttttctttttcttttacatagtcctcctgatccagtataagactatttagtaacgtgcatttgtatggtactatctaaagtaagttagattgatgtaagagatcgggtagctgcggaacaaaattagttatatcctaattaggtacagtgaatgacacaaaatcattttagcaatgcttcttaaccttttggggtcacaggcgttttgagactgatgaatcctagggacttatttacccaggaaaatgcgtatataacatacatatctccctaaagtttacaatattgtagtggttcatgggccccctggttaagagcccattctaaagtacaatagggcatcatcccttttcctgcaaagcccaaaagtatatttctagggcatgaaaataacttgagtctattttaaggaattgtttcactctagaggtagataggggacctggctagaatctgacattaaaatatactttttaaaaaatattatatttggggtgggggtcctggccaagaactcagtcatttttttgtgtaccaggttgcctaaatcatgtgcagatggtttta

SEQ ID NO: 28624 - DNA, 2531 bp, Homo sapiens
aggcattaggaagccttctttagagttcaaaattttagaagcctaatttgctcttacttccttcaattatgtgccatgtgttttggtttgtatatgttttaaattgtatatttccttggaatatgcttgaaatatttaagaatacattttcaaaatgtataatactgtattgttttgttgatcagaataataagtctcagttaaatgtttgttattactgatagtcaaaatgctcaatagaaatgatgagaggcattggttccaattcattgtcaaatgaacgttttctaattttgttcacagattctttccctttcgattgttctgtatgttaagatagtggcttctgctctcactgttttcctatttatattactagcaggtaggagtgctaattagaaaaacttagatggtattgaaattacagttgacaacttatatttttatgagatggagaaaaaagattaagttgatataacaacaaagtggactttttttcttccttatcctgcacgaaatattgcccttgtttcctctactttcctcttggtgttttctctttttttcaaacagaaacaggccaattccattttcttgagcaagaaagcttagtgtgttacttcatcaaggccagctaatactgtgttaaaccgggctgaaaatgagaaaacttgggagatggaggaatggggaaatggcagtgggataggtagggaaggattactcttaattgttttaaaagccataggaaagtcttccttgtacgtggctgtaaatttataagaactattgtgtcacataaaccaacaagaatgaacctttgctgcttcagataatttgatttttccagcaaggaaattaataagttactgattcttcagcatagaaacaactgagaagaattaatgcaatgtttcttcactagaaaacccaacccttcatttcttttcattgctccaaaacccagttttcaactaatggttttctcattaaactaaatgtttagaaaagttgtttagagtttttctttttcttttacatagtcctcctgatccagtataagactatttagtaacgtgcatttgtatggtactatctaaagtaagttagattgatgtaagagatcgggtagctgcggaacaaaattagttatatcctaattaggtacagtgaatgacacaaaatcattttagcaatgcttcttaaccttttggggtcacaggcgttttgagactgatgaatcctagggacttatttacccaggaaaatgcgtatataacatacatatctccctaaagtttacaatattgtagtggttcatgggccccctggttaagagcccattctaaagtacaatagggcatcatcccttttcctgcaaagcccaaaagtatatttctagggcatgaaaataacttgagtctattttaaggaattgtttcactctagaggtagataggggacctggctagaatctgacattaaaatatactttttaaaaaatattatatttggggtggggaaagtgattaaaaggtgaaaaaaaaacatagtattcagaagttttggaggttaatgtctttctctaagatttgccactttagaaattcaacagaaaagaggtaaaacagaaatggaatgtatctggaacatttttggcctccatagtgcagatatactatattaacaagtaatacatttatttacctgtcagatctccaggttttaagattttgagctttctagtattaggattcattaaatgttcaattcatttcatattctaaggaattaggttatttacttactaattcaggatgttaaaataacatccaagtcggacaaccaccaccaatgcacacagttaatgagatttctaaaatataataagtacaatgtaacaaacgtatagaattttgcatttgttgccaaaattagatgtttaatgacagcttatttaattcccatttgtgggacttctggaacatagaaaccattatcttacctggttatcccttgactaaatagcatatctgcaggaaaatatcttgtttgtagtgatatgccccaatagtgattgatttcactcttgaaatgagttatatcacttaatttgtataaatgttatgagtggagagacatgtacatgttaaaagcatgttgcattatatattcattttttaaactctataaatgttaagaataatataattgcagaaatatttttcttaaatacaatgtgtaacaaaattctccgtagcaactcacccactttgcagtttatgtgatccacacttttaaagaaattccataaatgtatattttgtattatgtattatttcctggtccaaagaaaatatgtgaattcagttctaactttaagaatgtactgtttgttttcaagttcattgaaaaattgcattcagcctgcgaatggttgcagattgtatgttagatgaaaagtagaaataatttctagtttggaaaactggtgccactaaataaacaggcaattacataaaaaaaatgta

SEQ ID NO: 28625 - DNA, 2594 bp, Homo sapiens
aggcattaggaagccttctttagagttcaaaattttagaagcctaatttgctcttacttccttcaattatgtgccatgtgttttggtttgtatatgttttaaattgtatatttccttggaatatgcttgaaatatttaagaatacattttcaaaatgtataatactgtattgttttgttgatcagaataataagtctcagttaaatgtttgttattactgatagtcaaaatgctcaatagaaatgatgagaggcattggttccaattcattgtcaaatgaacgttttctaattttgttcacagattctttccctttcgattgttctgtatgttaagatagtggcttctgctctcactgttttcctatttatattactagcaggtaggagtgctaattagaaaaacttagatggtattgaaattacagttgacaacttatatttttatgagatggagaaaaaagattaagttgatataacaacaaagtggactttttttcttccttatcctgcacgaaatattgcccttgtttcctctactttcctcttggtgttttctctttttttcaaacagaaacaggccaattccattttcttgagcaagaaagcttagtgtgttacttcatcaaggccagctaatactgtgttaaaccgggctgaaaatgagaaaacttgggagatggaggaatggggaaatggcagtgggataggtagggaaggattactcttaattgttttaaaagccataggaaagtcttccttgtacgtggctgtaaatttataagaactattgtgtcacataaaccaacaagaatgaacctttgctgcttcagataatttgatttttccagcaaggaaattaataagttactgattcttcagcatagaaacaactgagaagaattaatgcaatgtttcttcactagaaaacccaacccttcatttcttttcattgctccaaaacccagttttcaactaatggttttctcattaaactaaatgtttagaaaagttgtttagagtttttctttttcttttacatagtcctcctgatccagtataagactatttagtaacgtgcatttgtatggtactatctaaagtaagttagattgatgtaagagatcgggtagctgcggaacaaaattagttatatcctaattaggtacagtgaatgacacaaaatcattttagcaatgcttcttaaccttttggggtcacaggcgttttgagactgatgaatcctagggacttatttacccaggaaaatgcgtatataacatacatatctccctaaagtttacaatattgtagtggttcatgggccccctggttaagagcccattctaaagtacaatagggcatcatcccttttcctgcaaagcccaaaagtatatttctagggcatgaaaataacttgagtctattttaaggaattgtttcactctagaggtagataggggacctggctagaatctgacattaaaatatactttttaaaaaatattatatttggggtggggaaagtgattaaaaggtgaaaaaaaaacataagtgacttcgagagaggttatccggaggcgtttacattcgttctatatactacctaagaagtagtgtatgtccatcgtatgtgagcaatatttcctagagcatgcataatacgaaggtgagagatcacgaagactgagaatcgtactactcggaatcaattgtctccggccctccatagtgcagatatactatattaacaagtaatacatttatttacctgtcagatctccaggttttaagattttgagctttctagtattaggattcattaaatgttcaattcatttcatattctaaggaattaggttatttacttactaattcaggatgttaaaataacatccaagtcggacaaccaccaccaatgcacacagttaatgagatttctaaaatataataagtacaatgtaacaaacgtatagaattttgcatttgttgccaaaattagatgtttaatgacagcttatttaattcccatttgtgggacttctggaacatagaaaccattatcttacctggttatcccttgactaaatagcatatctgcaggaaaatatcttgtttgtagtgatatgccccaatagtgattgatttcactcttgaaatgagttatatcacttaatttgtataaatgttatgagtggagagacatgtacatgttaaaagcatgttgcattatatattcattttttaaactctataaatgttaagaataatataattgcagaaatatttttcttaaatacaatgtgtaacaaaattctccgtagcaactcacccactttgcagtttatgtgatccacacttttaaagaaattccataaatgtatattttgtattatgtattatttcctggtccaaagaaaatatgtgaattcagttctaactttaagaatgtactgtttgttttcaagttcattgaaaaattgcattcagcctgcgaatggttgcagattgtatgttagatgaaaagtagaaataatttctagtttggaaaactggtgccactaaataaacaggcaattacataaaaaaaatgta

SEQ ID NO: 28626 - DNA, 859 bp, Homo sapiens
ttaactagcccaatctattcctttaattcggcccatcccttcatttcccataagggatacttttagttaatttaatatctatagaaacaatgctaatgactggcttgctgttaataaatacatgggtaaatctctgttctgggctctcagctctgaaggctgtgagacccctgatttcccacttcacacctctatatttctgtgtgtgtgtctttagttcctctggcgctgctgggttaggatctacccgactgagctggtctcagcactgttatttgaaacaatgtaaataaacctatagggtttattatatatactaagtgaaataagccagacacagaaaaaaaaatgttgcatgatctcacttatagtgaaacttaaaaaaaaaacccaaatacatagaaatagagtagaatggtggttaccagagatgaggaaaatacagagacacaggtcaaaagatacagagttgcagttacaaagggtgagtatgtctagatatctaacatacagtatgaggactataatagtattgcactgtgtactgaaaacttgatgacagattttagatattcttaccacacagacaaaaagaaatgtaagtatgtgagatgaagcttatgttaattagattaagtgtatgtacataaaaacatcacattatacacatcaaatatatacaataaaaaagcacattgggagatacatgataaatttctatctgcagttgctatttgcatttttaaaggatatttttattttttaaatttttagctgacaactgtataattatggaatacaatgtgatgttctgatatatgtgtacactatggaatgattaaatcaaactaacatttca

SEQ ID NO: 28627 - DNA, 368 bp, Homo sapiens
ggattacaggtgtgagccaccaagcccggccaaccttactaattttttaaaaaatttgtaaagatggggtctcgttatgttgtccaggctaaatttgcacctttaaaaaatttattacaaaactttgttgttgttgtgtttgtagagacggtctcactgtgtggcccaggctgatttgaattcctggcctcaagtgatccttttgcttcagcacctccatggtgctgggattacaggtgtgagcagtggctgtattcagcttaatttgtagttatttgaagttacacaaattgagatttccaaatacagtaacatttttctatgtttgttagaattatcctttgtaaaaggcatcatttaggttattc

SEQ ID NO: 28628 - DNA, 2159 bp, Homo sapiens
cccactgagattgtgaaccagcctccatctacaccaagaacacccagcactgaaggagatgggaggggctgatgcccacctggagctctctgcttcctgcccacagtgctgacgagtacagagctaaatggagcagctactgcagaatccagtacagaatcggtccaggagggtgcggctgtggacaggccagcatccccagcaggttctgggaggcgcaccttgaaaggggaaggcagacatcctgagtgatgggcgcctgtggccctgagactgtggatgagggggctaggctccagctggcttctgaggggcctggaaaggcacacaagtaggtccttggctgaactggtgccccagcaggacctcgtgtccctgcactgctgcagatgcatcagccctccccatgttggtgccgctgtcacttcctactgggatccttcccctatccagccacatccaggctgtgggactacacggtgccctgttcccctgggcaggagaagaggtggtacctgcaatgcaccttcacagccaggcaagcattctggatttaccctgtgtaaagaagggtggtaccctctttcaggggtgtgatacagtgcattgatggagcagctggtgctgctgggaggccagcctggaagaggcagcagtggctcaagtttgcgtgcaggagccagagtgggacccacgggctcttgtgggtgtggtttagaactagatggtgctttggggacaagccatccaaaaaccccaggcccacatccaccctgatttgatatcccacttcctgacagatcagaggctgtgtctttaggcagtggaggtccaggagcagagcctggggctggttcacagctaaacccctccttagggcagcccagagtagggcctcagctggcaagtccacaagccctgctggggccctgcttgttggcctgacccctccctcaccaggcagccagccaaggtggttcctgcttcacccactcagtcatcagcctcaggctgcccaaaatgcctctgacaccagatttatatcttctgggcggcttctttaaatccagcccttcacccgccccctagagaagcagtgaaaccccttggctagtccagctggaagagctagaccgcaggagccgcgccgtcttcctaacctcgcctcggccttcgctccacagtggagagtgggagcctagctgtgcttgatgctgaatgcctgttttgagagtgtgagtgggatcatctacagtaaatacttgcaaagcatggcactgtggctctggggagctggtacgcctgtgctgtaaccatggtactcagtccttccaaagtgtttattaatcaagcacctgtcatgtgccattgagcccacgatggggaatgaggacagtccctgcccccatgaagcttgtgtcctgttgggaggacagacaggtggcccagcagttgcagcatggtgtgtgcacacgtttggctggtggaaccatgtttctaccactcatggtcaaaaaaagcccaccaaagtcctgggagttcacatctgtgtgatgatacggcaacattgtttgtaatggaaagactggacacccccagtgcccatcagtgggggagtcattaaataaactatggtatgtgcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagggggggggggaattatttttggggggggaatacttttttttgaaagaagaggggtgctccgctaatggaggggtgatattatattaaataaaagaagggcggggggggcgttcttaaaacaaaatagtttggttggggtgggagagaagaacagtgagttagtcttcgggtgattttgagggagggagaacaaccaccacttgggggggggagggaggtaacaatgtgatgggtgagcaaccataccaggcaagaagaaattagctcgagcgctagaggaagtataaataataatactgtggagagggatatggtatgagaaacacacaatcattgtgtgtcggcagagaagaatagttgcgttggcgatagatgattataagcactattgcgt

SEQ ID NO: 28629 - DNA, 1645 bp, Homo sapiens
cccactgagattgtgaaccagcctccatctacaccaagaacacccagcactgaaggagatgggaggggctgatgcccacctggagctctctgcttcctgcccacagtgctgacgagtacagagctaaatggagcagctactgcagaatccagtacagaatcggtccaggagggtgcggctgtggacaggccagcatccccagcaggttctgggaggcgcaccttgaaaggggaaggcagacatcctgagtgatgggcgcctgtggccctgagactgtggatgagggggctaggctccagctggcttctgaggggcctggaaaggcacacaagtaggtccttggctgaactggtgccccagcaggacctcgtgtccctgcactgctgcagatgcatcagccctccccatgttggtgccgctgtcacttcctactgggatccttcccctatccagccacatccaggctgtgggactacacggtgccctgttcccctgggcaggagaagaggtggtacctgcaatgcaccttcacagccaggcaagcattctggatttaccctgtgtaaagaagggtggtaccctctttcaggggtgtgatacagtgcattgatggagcagctggtgctgctgggaggccagcctggaagaggcagcagtggctcaagtttgcgtgcaggagccagagtgggacccacgggctcttgtgggtgtggtttagaactagatggtgctttggggacaagccatccaaaaaccccaggcccacatccaccctgatttgatatcccacttcctgacagatcagaggctgtgtctttaggcagtggaggtccaggagcagagcctggggctggttcacagctaaacccctccttagggcagcccagagtagggcctcagctggcaagtccacaagccctgctggggccctgcttgttggcctgacccctccctcaccaggcagccagccaaggtggttcctgcttcacccactcagtcatcagcctcaggctgcccaaaatgcctctgacaccagatttatatcttctgggcggcttctttaaatccagcccttcacccgccccctagagaagcagtgaaaccccttggctagtccagctggaagagctagaccgcaggagccgcgccgtcttcctaacctcgcctcggccttcgctccacagtggagagtgggagcctagctgtgcttgatgctgaatgcctgttttgagagtgtgagtgggatcatctacagtaaatacttgcaaagcatggcactgtggctctggggagctggtacgcctgtgctgtaaccatggtactcagtccttccaaagtgtttattaatcaagcacctgtcatgtgccattgagcccacgatggggaatgaggacagtccctgcccccatgaagcttgtgtcctgttgggaggacagacaggtggcccagcagttgcagcatggtgtgtgcacacgtttggctggtggaaccatgtttctaccactcatggtcaaaaaaagcccaccaaagtcctgggagttcacatctgtgtgatgatacggcaacattgtttgtaatggaaagactggacacccccagtgcccatcagtgggggagtcattaaataaactatggtatgtgcaca

SEQ ID NO: 28630 - DNA, 217 bp, Homo sapiens
gcggccgcctactactactactactgctcgaattcaagcttctaacgatgtacggggacatgacccaatcctgtatttatttctaccccctttttgaaagtatttataaaactagttgaggacagctgtatttttttgttgaactatttagtagaattgtgcctttttgtctgtatgtgaataaatgctgtacattttgcaatacaaaaaaaaagtc

SEQ ID NO: 28631 - DNA, 5781 bp, Homo sapiens
ctctcgttttggcaagggattaaagtgctcccccctgtggcagcagtgacccagaaatgagtttgattcacatagtccttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaggtgcatgaagagttaaaaatcaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaatacaaaaaaaaagtc

SEQ ID NO: 28632 - DNA, 5692 bp, Homo sapiens
gggctggtacggtccggaattccttgtgacttgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaggtgcatgaagagttaaaaatcaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaatacaaaaaaaaagtc

SEQ ID NO: 28633 - DNA, 5799 bp, Homo sapiens
gccgagaggctcagccatatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaggtgcatgaagagttaaaaatcaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaatacaaaaaaaaagtc

SEQ ID NO: 28634 - DNA, 5649 bp, Homo sapiens
cagtcagctaaagattcctggagtagttatagtaataatgtcacaggaatatagaaagaaacctggcatctttgggagacctactgatatgtgacttctccacccctccccctccttttttaacctggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaggtgcatgaagagttaaaaatcaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaatacaaaaaaaaagtc

SEQ ID NO: 28635 - DNA, 140 bp, Homo sapiens
aaagtaatggatcttttagtttctgacattcatgttcagcctttgacgacctgagccaccctgtcttgctgttttccgacctttaggtgagcattggcagcccagagaagatggagcccatcaccaaggtgtcacacatt

SEQ ID NO: 28636 - DNA, 683 bp, Homo sapiens
gaattatttcacacatttcctttattcattcacatgtttacatgtacttgtcctcgtaatagccctgtgagggtacagacacatagagaaacttacaagccccgagccctgctttttgggtcctctcagtctcgtacgggaggcagaagactggaccgtggaggagcgcggcgcaggtgctgctctgtaaccaggtagagggagcagaggcagccatcagccacctgatgagttctgcatggagtccgctctgaaaatcagatcagttattttgtttggaggaggtctagttttatgaaaaattatgtgagcttcagctgttttagaaaatgtggcatattgagtctgcagattgaatggagattctcaaggcaggtcatctcttcactataaaaaccaaatttgtacaaacttggtggtgtaagtgttgtgttgttgggtggggagttcacatcaattgggccacactaagggtgtagaattttattcttttggatttgcttctgctgtaatttttctttatttgtggttttatgtttataggtgtgccttcttcctgctcctcctcctcactggaaaacatgcttttgtttaacagtccttctgttggccctgatgctcccaagatagaggacttgaagtggcattctgcattcttcagaaaacaaatgggtacttccttg

SEQ ID NO: 28637 - DNA, 3643 bp, Homo sapiens
ctctcgttttggcaagggattaaagtgctcccccctgtggcagcagtgacccagaaatgagtttgattcacatagtccttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgta

SEQ ID NO: 28638 - DNA, 5600 bp, Homo sapiens
acggcacccgccagtgggggtgcctcaacttccgcgggcgtttaaatagcagcctctctcccctcccaccggtaataggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaggtgcatgaagagttaaaaatcaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaatacaaaaaaaaagtc

SEQ ID NO: 28639 - DNA, 5728 bp, Homo sapiens
ctctcgttttggcaagggattaaagtgctcccccctgtggcagcagtgacccagaaatgagtttgattcacatagtccttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggctgcctgctgtttcccggggagatcatgaaacgaggtcgccttcccagcagcagtgaggattctgacgacaatggcagcctgtcaactacttggtcccagaattcccgatcccagcataggagaagctcctgctccagacatgaagatcgaaagccttcagaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtgagcattggcagcccagagaagatggagcccatcaccaaggtgtcacacattcccagcagccggtgggcgctagtgtgcagcctctgcaatgagaagtttggggcctctatacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaatagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaggtgcatgaagagttaaaaatcaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaatacaaaaaaaaagtc

SEQ ID NO: 28640 - DNA, 481 bp, Homo sapiens
tcattcttgaagtcagtgagaccaagaacccactaattctggacacactaggatctatgtgtttccttaaagtcttagtttgattatgtcaagtttagcacaagtggctccattttggtttggtctgggctgttggggcctagtgcatgaattcagtccaaaacaatggcctcccataattttgtttaaaaatttcccattgcatctgccattactgaggcttgagtaggcggttttcccctcacagtgtaaacaaagccaccaggaagttcaaactgggtggagcccactgcaactaggcaaagctgctgtagccagactgcctctctagattcctccactctgggcaaggcatctctgaaagaaaggcagcagccccagtcaggggcttatagataaaactatctgtaataacacctggggaaacaggtggctatggagtcagcttcagcggacttaaacattcctgcctgccagatct

SEQ ID NO: 28641 - DNA, 555 bp, Homo sapiens
catggtgatacgcgcctgtaatcccagctactcaggaggctgaggcccgagaattgcttgaacccaggaagtggaggttacagccagcggagatcccagcattgcactccagcctgggtgacagagtgagactgtctcgaaaataactttttccctagatttcacaggatcttctgagtagatgattatgttatctgcatgtaaagcctgttttacatcttctttctaagctacatgccttttgtttcttttccttgcctaagtgcattggctagaacctcctgtgcaatgtgaatagaagtggtgagagtagatattcttgtctcgttccctatcttggggtgaaagcactctatcttcaccattaagtacgatgttaacagtaggtttatcttagatgccttttataaggtggaggaagttcccttcaatatctagtttgctgagagtttttatcaagaatggacattgggttttatcaaatgcttttccggtatttactgagataatcatggttttttttttttttaattttttactctgttaatatggtga

SEQ ID NO: 28642 - DNA, 756 bp, Homo sapiens
ggataacagcagtcctcatttcctttggacactggggtcagtggggagagagtttgctccgaagcacaaacagctccaatccatgctggaagagaccccaggccacaatagcccttgacacagagctctatgcagggctgtgctgcccaagacgcttgtcgtgtgctgatgaaaagggctggggagaagcaaggggcaggggaggggcagaactccacaagagggcaaaacctgctgtcagcaatgctctcgtggctgttcaagggaagtgagatacttgtactatgcatttcatttttaggactagaattctgtcttcctgcccaacttcaatataagtgtggactaaaatgcgagaaaggtgtcctgtggtctatgcaaattagaaaggacatgcagagttttccaactaggaagactgaatctgtggccccaagagaaccatctctgaagactgggtatgtggtcttttccacacatggaccacctacggatgcaatctgtaatgcatgtgcatgagaagtctgttattaagtagagtgtgaaaacatggttatggtaataggaacagcttttaaaatgcttttgtatttgggcctttcatacaaaaaagccataataccattttcatgtaatgctatacttctatactattttcatgtaatactatacttctatactattttcatgtaatactatacttctatactattttcatgtaatactatacttctatattaaagttttacccactca

SEQ ID NO: 28643 - DNA, 847 bp, Homo sapiens
ggataacagcagtcctcatttcctttggacactggggtcagtggggagagagtttgctccgaagcacaaacagctccaatccatgctggaagagaccccaggccacaatagcccttgacacagagctctatgcagggctgtgctgcccaagacgcttgtcgtgtgctgatgaaaagggctggggagaagcaaggggcaggggaggggcagaactccacaagagggcaaaacctgctgtcagcaatgctctcgtggctgttcaagggaagtgagatacttgtactatgcatttcatttttaggactagaattctgtcttcctgcccaacttcaatataagtgtggactaaaatgcgagaaaggtgtcctgtggtctatgcaaattagaaaggacatgcagagttttccaactaggaagactgaatctgtggccccaagagaaccatctctgaagactgggtatgtggtcttttccacacatggaccacctacggatgcaatctgtaatgcatgtgcatgagaagtctgttattaagtagagtgtgaaaacatggttatggtaataggaacagcttttaaaatgcttttgtatttgggcctttcatacaaaaaagccataataccattttcatgtaatgctatacttctatactattttcatgtaatactatacttctatactattttcatgtaatactatacttctatactattttcatgtaatactatacttctatattaaagttttacccactcaaaaaaagaaaaagaaaagaaaaaacgaaagaagaacaaacacagagaaagaaagaaaagaaaagagaagaccaaaaggggggggaaaaaag

SEQ ID NO: 28644 - DNA, 207 bp, Homo sapiens
ataaattgaggcttaatctaaggaaactggatgcattaatgttgtcatcatacttgataaactaagttgataaatttataaaatacaagaattctaaaaatgtttcacatgcctagaaagtagggaaatattccaaacagtgttcagtaatacaattttaaacaaaataatagaatctcttaattttaaaattgatgtataatttgc

SEQ ID NO: 28645 - DNA, 247 bp, Homo sapiens
gctactatgcacacctttacgcacataaactagtaaatctagaagagatggttaaattcctggaaaaatacaaccctcctagcttaagtcaggagaaattagataccctgaacagacctctaacaagcagcgagattgaaagggcaatttaaaaatttccaacaaaaaaagtccaggactagacagactcacaacagaattctaccagacattcaaagaagaattggtatcaatccttttgacacta

SEQ ID NO: 28646 - DNA, 314 bp, Homo sapiens
tgttttggaagtagagaaccagcctcactgagatgtgtctgccaggcagaagagcaaaccctctcgccttggttgggagactcttccttccctcccagccccccagtgttgtccctgtctgcgttccctctctgtctacaccccccgtgataacaggtgaactccagggcatacttgtttattgaattaattaattaaaaatggaagctggaccaggcgtggtggctcatgcctgtaatcccagcattttgggaggctgaggcaggtggatcacaaggtcaagagttcgagaccagcctggccaacatggtgaa

SEQ ID NO: 28647 - DNA, 348 bp, Homo sapiens
aaggtgtgcacttttactgaactggtctcaagtcagtgtacaggtatgccctggatgcctccacacttccacccactcccagggagaccaaaagccttcatacatctcaaggtagggacaaaaatggggaccatgatagctgattattcaaaataaaacaaaaagtattaaggtgaagatttttttaaatgttgcattacataatttacatgaaagcaatcctgtaacctcccctttgtggactcaggagagaactgggccgttctcctgagagaagtggggtggcttttgggagggcaagggacttcctgtaacaatgcatctcacaatatgtggaatgactattta

SEQ ID NO: 28648 - DNA, 383 bp, Homo sapiens
tatactactaattcgcggcgctcgacttttttttttttgaaacggagtctctctctgtcgcccaagctggagtgcaatggcgcgatcggctgactgcaagctctgccttccagggtcacgccattctcctgcctcaacctcccgagtagctgggactacaggggcctgccaccacgcccgggtaattttttgtatttttagtaaaaataggggttcactatgttagccaggatgccaggatgggctcgatctcctgacctcgagatccacccacataaactatctttataaaagccaggggcttgattcctaaatgtttttaaacctaaacatttatgaatttatccatgacaagatcactggttgtagtaagggttcttttg

SEQ ID NO: 28649 - DNA, 204 bp, Homo sapiens
ccaagagtgatcagaaagtaaacagaaaactccccctgccccaaatatggaccagtagagaggtagaaaggatgccagagataatcatacttgtttagaggtatcgtaattttatttgtggtgtggtttcttgttttgttttgttaatgtgggatgggcctgtaaggtggcctaagacactaccaatttatgagtttggctaag

SEQ ID NO: 28650 - DNA, 1074 bp, Homo sapiens
  misc_feature (701)..(701): n is a, c, g, or t
atgaattgggtaaataagagtgtcccacaggagttcattctgttagttttctcagatcaaccatggctagagattccaccctttgtgatgtttctgttttcctatatcttgacaatctttggcaatctgacaataattcttgtgtcacatgtggatttcaaactccacacccctatgtacttttttcttagcaatctctcactcctggacctttgctataccacaagtacagttccacaaatgctggtaaacatatgcaacaccaggaaagtaatcagttatggtggctgtgtggcccagcttttcattttcctggccttgggttccacagaatgtcttctcctggccgtcatgtgctttgataggtttgtagctatttgtcggcctctccattactcaattatcatgcaccagaggctctgcttccagttggcagctgcatcctggattagtggctttagcaattcagtattacagtccacctggacacttaagatgccactgtgtggtcacaaagaagtggatcacttcttctgtgaagtccctgctctgctcaagttgtcctgtgttgacacaacagcaaatgaggctgaactattcttcatcagtgtgctattccttctaatacccgtgacactcatccttatatcgtatgcttttattgtccaagcagtgttgagaatccagtctgctgaaggtcnacgaaaggcatttgggacatgtggctcccatctaattgtggtgtcacttttttatggtacagctatctccatgtacctgcaaccaccttcacccagctccaaagaccggggaaagatggtttctctcttctgtggaatcattgcacccatgctgaatccccttatatatacacttaggaacaaagaggtaaaggaagcctttaaaaggttggttgcaaagagtcttcttaatcaagaaataagaaatatgcaaatgataagctttgctaaagacacagtgcttacttaccttactaacttctccgcaagttgtcctatttttgtcattactatagaaaactattgtaatctccctcaaagaaaatttccttga

SEQ ID NO: 28651 - DNA, 360 bp, Homo sapiens
aacaggtgtgagccactgcacccagcctcttcttggtattttaaaatgttgttacttttactagaatgtttatgagcttcagaatctaaggtcacacgttcgtttctgtttatccagtttaagaaacagttttgctattttgtaaaacaaattgggaacccttccatcatatttgtaatctgtaataaaataacatggaattggaatagtaattttcttggaaatatgaaaaaaatagtaaaatagagaaaataattttaagtgttagtatttttatttctttattatttttagtttatcatcctgcaaaattaaaagttatatccctggatcttgttaagtcgaaattaaactgtaata

SEQ ID NO: 28652 - DNA, 506 bp, Homo sapiens
agaataagaataaagttggagaactgacactacctgacttcagtacttgacttcaatactttaaggctacagtaatcatgacagtgtagtattggtgaaggaataagtaaatagatccatagaatagaatagagaccctagaagtagatccacacaaatattgtcaatagatctttgacaaagtagcaaaggcaaaccaatggaaaaagtcttctcaacaagtggtgccagaacaactggacatccacttgaataaaaatgaatttagacatagaccttacatttttccaataagttttttcataatacttttcccctaagaccaggaataaggcaaagttgatcactttcaccattcttcttcagtatatttctggaagctaccacagtaagggaagaaaggtaaatataagcatatagattggaaagaaagaaatgaaactgtccctgtttgctgatgacatgacagtctacgcagaaaaattaaaaggaatctacaaaaaaaa

SEQ ID NO: 28653 - DNA, 235 bp, Homo sapiens
ttatggatagtctcttctaaattgagaaaaagggattttccctcctgatactgagaagctataaatattttcatttacctttactcccacctttttaattttagaatgaaaacagcccctctcatccctcccaaaattagtttttcccagtgcccatgatttctcttgggtgggaagactaagatgagtcttaactttcatcctgaatcaagtcactgcagtgatgacccagtat

SEQ ID NO: 28654 - DNA, 386 bp, Homo sapiens
tgtttttaccacaatttattcatccattcccttactgatggtctgttttaacattaatatactcttacaacctaggaatctcctgggaatctatccctaaggaataaaaagcgccagcacttaagattatatgtttactaatgtatattgtattttttggtaaggaccaaaaaaacaaacaaaaaaaagaccatcagtaagggaatggatgaataaattgtggtaaaaacataccatggctgaatggtatttccttgaaaagaatgtgtgggaacaaactccaaacttctctaggtcaaatgaggaaagcaagaggggagagagagagtgtatgtgtgtgtgtagcagtttttataaaataaagataaacccttataaaaaaaagt

SEQ ID NO: 28655 - DNA, 1327 bp, Homo sapiens
aacagaagacagtgttgaagttttccctgcttctggttgctgaagattttctagactgcttctggttgctgaagattttctagaagcactatttacacaaatatgcaaatgtgaaataaccgatctataacgtgaaggaggcagacatgagctgtactactcagtatgcaccacagaataagagtttgccgtgtaaagacaatatccccattcgtcatgctcttattttcccgtgggatatttgcatacaaatgcatgtctgttaccaaaatattgtgtaacacagacagaaaccacctgtttttgtctttccttgtttcccttaatatttcatgaattgtctagcaaaaatggtaggatgcttctgtagttcacaaatgttacatttcagagactttagaggaaaaattattttaaataactgtcaactgtttcattgctttttaaatttttcacgtgcataaccccctttagaagtaaatttttacactattttgttgtttaaaggaggcatttctacttccttgagttttgctgttgccaacctaaaacatttccctttggaacatgagttataagttattacttttcctttacatgtttacacttttataaaaatcagatttttcagtggtctctccagatattaacaagaattgttgtgtaactcaaagatttgcttttatagacttgatttcaaattcttaagttcagcctttccctatcaatcacaaatcatgtattggaaattataaatggcaaccaaaaactggcttttaaaaaatatttttggatatcattgatgtgctgtcacactatatattgagtgactttctgaacaaatttatccagaacatccatagcccaataagcttttgtctaagttgtcatcttacttactcacaaaggaggggaaaacgttattttcatagctgcttttagaaatgtagattgtaacagcctccttggacaacattgtgagtctgttttaacattaatatactcttacaacctaggaatctcctgggaatctatccctaaggaataaaaagcgccagcacttaagattatatgtttactaatgtatattgtattttttggtaaggaccaaaaaaacaaacaaaaaaaagaccatcagtaagggaatggatgaataaattgtggtaaaaacataccatggctgaatggtatttccttgaaaagaatgtgtgggaacaaactccaaacttctctaggtcaaatgaggaaagcaagaggggagagagagagtgtatgtgtgtgtgtagcagtttttataaaataaagataaacccttataaaaaaaagt

SEQ ID NO: 28656 - DNA, 688 bp, Homo sapiens
aactttaccaagtaaaaccaagccatactctttttgagccaattaagaaaattgccatttttttttaaatgtagcatttcagggtaaagacccatgaaatgacttagtggattctagactactgaaagaaaacccacctcaaagattttgttgaaagttttagtgttgtcctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactattaa

SEQ ID NO: 28657 - DNA, 907 bp, Homo sapiens
agagttgacaactcttactactcttactactgttaactcatctcagctactattctggaggaacacaaagcactcggctttggtgctaacccactgggagttggccttatcttgaacagttgcaaaactcatccacagttcatcatctgctgaagagtggcttgcagatgatgaactgggaaactccataggtttccctctgaaatgttcttgcccggtatttcactcgtttgtctctcctcatgacactaagctccatgagagtaaggcctgtcctgtcttgtgtatcacaggattctcagcacttaggacaagacctggctctgatgcttcctaaatatttgttaagtgaatccgttttagtttaaaaaaacaataaaacttggtttgttgataagctatgaactcctttacccaaaccctgtcattaacatggaagatgcacaagatcatttattgtctactctagctaattggcctaggagataattcacataacaattgatttttatatactcatagccctgaaatttcctggctataaagacaaatcccttgctctatgtgtgtggtggcctggccatgccagttctcttaagtaaacagtcactctgtcgttatccacccaattctcaaaatcaagccccatgtaaatagtcatctccataaatcctgtcaagaaaattaatttttagggtacagtcattggttttattgtagtcctcctaatcctgtgtgacatagatcctttggaaagttggtgctaccagttgggaagtgccccagcaggccccgtggttgtctggctttgttgactgtctgaatgcaacacgttgacaatgggttagctgctttggttttagggttattctccttatgcctcatgcaaatgaaaagtggcaaaaaa

SEQ ID NO: 28658 - DNA, 319 bp, Homo sapiens
aaataatttttttaaaaaagaaaaagacaatagtattacccatgggacaaaatttgtactattagcaagaatcattttgtgtctcatttagaaacaatttgacttttgttccagtgtttaaactttgacaaaaatggttttgaatagatctttataacctgatgccataaatacaagattctctgataccttcatttaatatatcaatattgggcctaaaacagtattctgtaaagcttaaattggtattaactatgatcatcttgatgtctatgatagataataaacaaggtcatacataccttactaaacaaaacaa

SEQ ID NO: 28659 - DNA, 399 bp, Homo sapiens
ttagcttcccaagcttatgagtcttcccttttcttcccttttaaaaaagagaatgaactatctgttgatcctcagagtattttgtgaggtaattggacacatcttctgcacctggggtcaggtctgtcatatcagtgtaaaaaaaaatttttttccctcaaatcagtagactgaaattttatacctgtttatttggaggcttatagatggtgtgaaatagttcatctaataataaaattgggtactattaaaagcctttaatgtcttagtgattatcttggttttatttacctccagtgttaggaaggaattgtggtagggttttcaatttggggtagaatggctaggcaagttgacatttgtttatggtacaaagaaaatagatcatttgacctaaaa

SEQ ID NO: 28660 - DNA, 1461 bp, Homo sapiens
aaaaaaatattgtattgtttttaccctgatttgattatcagtattttaggttaatttgtaagagaaaaatcaagtaatgctgtaaaagctcatgtaaatcacagaaaagaactgttttaatgacttttgtttgcttttaataacatcaaggtattagaatttattaattgccatttttatgaaagtattaataaaattgtttgctacaatgatatttctgaagccacagtttgttaaatatatttgtctttccattatttttcagaaaaatataaagcagtaaccaaactgatcatttcacccagatttgagggtaagatatagctttagcctactgtttatattcaacttaactgctaaatctctgttaaaaaaaaacgctttctttagaaacatattttcaatctgtgttccttcccactggcagcccctttggagaagagtctgacagtgccaagatcaacatgctttgattcttgcccattcttttgaatcagttggattctgacataacttcagataagcaaatactaatattcagtcttaactatctgctcaaatacttttagaaacccttcagtacctctgtattccattgccagtttgcctggttacaggttagttacccacttatggagtgaattgtgatttgtatttggttcttttaaagatgaccaaaattatcaatccatgactttacccaaattattactgttgtggaaaatgaactaattgcattacggttaacttgagggcagaaatgaatgtaactgactatattgaccaatacagtgggtttaaggttcatatatttatggtaagaaaagtaaacacagaaacagagagagagagagaatataaattaagattgttgttgctttacacgtatacataggtatgctgaaggtgtgaacagtatagatagcatatgcaagtacttttagactaaatgccttatgcatctgaggagatacaccgtaggattgtgttattttatttatttatgagtactgagcacagagctttgggttccagccacttctgttatgtagacaagtggcatcaaatcaaggtttggcatcatttctagtgctcatcccattagtcactgtggtcagatgggctgaactaaaataaaatatcctgtttgtggcttcacttacctagaataactggtgacatatatcaagttcacctgataattgttaactctcaatttcagatttcctaaggatctattctttgttaatttaaaagctaatgggaactcaaatgaattttaataacttactttgtacaaaactgcccttaatctaatttggaattttattttgttttatttatttatttatttatttatttaatgtctttttagtttctactggttgataggattgtgttttaaaagggaaaatcgaggaagggaaattgtgttgtttatcttataggaaatgatggttt

SEQ ID NO: 28661 - DNA, 416 bp, Homo sapiens
actcccatcctcggttatccaaagattaggccaacagaactacatttgtaggagtcaaacagagaacaatggagataaaaatatctttttttgataaagctgttattactgataaagaccaggcttcaggtctgtggcccaaatgggcttcactcctgttagacaaactcattgagccacagatgctggaagctctaagttgccctggccctcccaatacccccaccacagggatttgcttctataaaattgatagcgtggaagagcagagcagaacagactctctgcacacaggtgcagctcaaagagaacaagaattaaggaagcatcacctaggtcatgtggcgccactcccagctcccaaactcaccaatcagagaagacactcctaggagagaggcgtgagcaactggatg

SEQ ID NO: 28662 - DNA, 982 bp, Homo sapiens
ttttaaggtcacgctgttttttgaataatagctcacaaccctcatgctgtgactcccaggctagtgttgtgtccctgaagcaacatatgcacaaacttaaatggctaaatgcaagaaatgtcaataaatgaagcagccatgggtaataagctggtgggattgttgagaactggacatttctgtcctttctaaagaagaaagtgatttgatgaactgcctggatggggtttctgctcatatgcacaatgtcagctaagaaagagctgatttgctggtgaaacatatactgactctgaagcagacaaagtttaaagaaaaaagtgggtgggagaaagtgagtcatacttggtaacattatctgaaacagtaaagaaacaggacattgcaaagtgaatccctatgcctcaatacaatgatagatttttagtttatttgttcgtgaaccatgatggaaggaagagaaggttatagaaccaagaaaatcttttgccactgttgggatgatgcctccaacaagtatatataaaatagtaagagctgttcttacaaagaaaaatattctaattggtgatgatgcctatggttgttggatggtactttttcttcccttcacatattattatggatgcattttcttagatgaatcttacctctttgggagagattttatagaattttcctattaaactagtgaaacatagaatagtactactggcctttctcctgaatgggcctttacacagtggatggcacatgctgtatgtgggaagaaaaagcaaattttctctgcagagcggttgatgcgaacaccacatctctcctgttaaaatggaatgttaggatttcataagtgtgctgcggcagtgtgttcacctttgctgcactgatgtttgttatgttgcctttccttgttcctaaatgcaaacatacatctcagtagtgttaagatggtaaatcttattaggtatattttaccacaatt

SEQ ID NO: 28663 - DNA, 350 bp, Homo sapiens
tcgacgggaggccacggcgtcggggatggggagaaagctcctcggaggataaatattagctctgcattcttgggttgggtttagtttggttttgaaagagtgttcatagaaatgaattatgaaaatcaacagaagtaatttcttaggcgtccagtggctttcttcccctttgtatgctaagatgattacctgtcacagggaaaatgtaagctgcaggttaaaatccaggaaaggcagtggggggatgggaatgacaccccatccagcccagaggcttcactccagccctcatctgcccacggacgtgtcattggcgtccggtgctacccagtgccagctgactctgccca

SEQ ID NO: 28664 - DNA, 446 bp, Homo sapiens
tggaattggagtttcactcttgttgcccaggctggagtgcaatggcccaatctcggctcaccgcaacctccgccttccaggttcaagcaattctcctgtctcagcctcccaggtagctggcattacaggcatacaccaccacgcccagctcattttgtatttttagtagagacggggtttctccacgttgaggctggtctcgaactcctgatctcaggtgatctgcccgcctcggcctcccaaagtgctgggattacaggcgtgagcctctgcaaccggccacttaggctactttaagacagatttatatcccttgcaattgagagaattttgaccaccataattagggactaatgaataagtgagtctggttagcgtttgggaggattcaaggggagaaatatgatgtgtcgtccattgtagggtagttaattactgacactgtc

SEQ ID NO: 28665 - DNA, 423 bp, Homo sapiens
tatctcagaaaaacaaaaacaaaacaaaaaacccgaacccggaaacattaaaaatagacttgtgctaagcgagtgaagtgtgatttctatacactatcaggaaatggccttcatgagaagtcctgaaaatgacctactgcccgaatcacagacacactagatgatagtgagagtccaaaggtaacttccacagacacagctaagtgattatacgactcttacaagctatgaaaagtttaagggtaaaagctttctatcttcattgtttctgaatcttaatgcccagcggaaatgccacacgggtgaactgtgcttgtgtggaacaaggctgcgaccccctaccacaccctcggctggctgttcccaggatgctgctcaccccaaccccacctccatttctgcccttctctgcttgctcagtgc

SEQ ID NO: 28666 - DNA, 247 bp, Homo sapiens
gcaattctgattaccaaagcagatgaattatacaaatctattaactgtagcataaatttgtaactaactttatgcaaatactcatactttatcaattatacttaagtacaaacattcaggtgctaattgtattttgtagttctataaatctctacagatcaaagataggagacaataaatgaacattcttaaaatgcctagtctccatgaaagaaaaagcaaaatagaaatgccaactattgctttt

SEQ ID NO: 28667 - DNA, 712 bp, Homo sapiens
aatagaatgtatatataagtatataataaggaattagctcatgcagttacagaggctgacaaattccaatatctgcagttggcaagctggagactcaggagaactgacggtgtagtctaacggctagcaggcccaagaaccaggaaaagctgattaaagttcaaaggcgggaaaaaaaaacccaatgtcccaacttgaaggcatttaggcaggaggaattccctcttatttatgagactgtcagcctttttgttctatttaggctatcaattgttttgatgaggcccacaacattagaaagggcagtgtgctttgctcagtctatcaatttcaacgttaaactcatccagtataatgtttgatcaactatctgggtatgccatggttcagtcaacttgacacataaagttaaccaatcgtcaaaaccccctacttttggtttcttgataaataaaataatatttatcttctgttttagtggaataaaggtatggaaaacgctttgatcagtttctgtcttttgttgatctggaattgcagtatcattgtgattaaagaaactaaaatacagtgtaattaggggatcacatccaaattttgcaaaccctttggtaatgtttagaatatatttgattaattcattttcaattcaacaaacacctgttaaatactaactatatgtcagctaggtacatgttatatgtcaatgaaa

SEQ ID NO: 28668 - DNA, 379 bp, Homo sapiens
cagagtaagataatgtctcaaaaaaaaaaaaaaaaagtagaattcccaagcagataacaatttaaatgttattaacagggcaacaaattatcaggtttatctttggtttatatggtttggtttgggtctatcattttattattgtaattatactagctttttttttgttcttctgcattttaacaaattatttgaatattattttagaattaaaatattttactattgcctttttagccattcttctttgcattatttatttagtggttactctagggattacaatacatgtctttaacttttcacagcccacttcatggaccacttcatgaaaaatgtagaagcttgcacaataaggcaactatataggctcatatcc

SEQ ID NO: 28669 - DNA, 918 bp, Homo sapiens
ttcttccaagccagctcgtcatattgggcccggatgtctgccatgattttggcaaggtcctgagatttggggcctctacctccacggtcaactcagagctggcaatctgggcttgtaggccttttacttcctcttcgtggttcttcttcatgaagagcagctcctccttgagggcctcgatctctgtctccagctgcagccgagtgacattggtgtcatcaatttccttgcaaagcccatggatgttgttctccacagactggcacatggccagctctgtctcatacttgactctaaagtcatcagcagcaagacaggcactgtcgatctgcagaacggtgcgggcattgtccacagtatttgcagagatctgagccctcaggtcctcgatggtcttgaagtaatggctccagtctctgacctgggatcccttcttctccagatgctcccggattttgctctccagcttctggttctcagtctccaggctcctcactctgcccaggtaggaggccaggcggtcgttcaggctttgcatggtctccttcttgttctggatgcctcccattcctgccagacccccggccatccccgtggccaggccccagaccccatgccaccctggaagctggtggagcaggacacggagatccaggaaccagaacccccagcacctgcatagacgcttgcctcactgctgaacagccaggggccgtagctgggcgcctggacagagcctagggactgatagttggtggaaaaggtggagccagtggtgaagctcatgctctccggcgggagagtgagaggacaggactcgggctttgccaacgaccaagatgacaatactctctcaattgatctacaagttaaatggaatccttattaaaatcccagctggcttaaattaagaaagaa

SEQ ID NO: 28670 - DNA, 370 bp, Homo sapiens
agatgtccccatgaagggggctgtctccttctgtcatccttggggcccaggaaagtctaagtcatgactctggctggctgaggttcagatctcagatctgccaaggctgggaaagtcacccctctgagcctcagtttccccatctgtactgtggaaggcacaaagttgcctaccccatggagatgctgtaacaatacagaagcaaaagtacctgatttggtccgggcatggtggtccatgcctataatcccagcgacttgcgaggctgaggcacaagaatcacttgagtccgggaggcggaggttgcagtgagctgagatcttgccactgtactccagcctgggagacagagtgagactccgtctttttt

SEQ ID NO: 28671 - DNA, 427 bp, Homo sapiens
  misc_feature (6)..(6): n is a, c, g, or t
agctcngtacctgccaaagcgtagtacccaactttctggtcagtcaccttctacaccttttagtttcccagcttgcttgtccaaggactcccacaccaccacttattttttagccagtcaaatttagcagtgggagggttctatgacacccccactctttaatctctttgggtactacgctttggcatgccaaagcgtagtacccaacacgacagttttttgacctgagtggtatcagaaataggctttactataaccaggtaaatacctgaacaaaggaaccctcatcaggaaggcactgtcactcttggcagcagcaatcccacaggaaaggagttcccctggcagagacagagagacagctactcatctgacaaaactctctcagtctgtcctttgccttgggtactacgctttggcagttagt

SEQ ID NO: 28672 - DNA, 381 bp, Homo sapiens
ctagtagagacgggggtttcaccatgttggtcaggctggtcttgaactcctgacctcgtgatccacccgcctcggcctcccaaagtgctgggattacaggcatgagccaccgcgccccgcctgacctacagaaatttcaaacggcaaccatggacacccaacacgacagttttttgacctgagtggtatcagaaataggctttactataaccaggtaaatacctgaacaaaggaaccctcatcaggaaggcactgtcactcttggcagcagcaatcccacaggaaaggagttcccctggcagagacagagagacagctactcatctgacaaaactctctcagtctgtcctttgccttgggtactacgctttggcagttagt

SEQ ID NO: 28673 - DNA, 2004 bp, Homo sapiens
cgcccttcccccaccaccagcggcgagtgggtgacagagcccccgtctccgcgcgtcttcgccgccctgcgccgtgacccgctgtggcactgggccacgagtggaggctgcgcccctccagttctgccttcatagttctctgcctttgcccaaaactgcagaaaatgaacaaatcccagggatcagtttcattcacggatgtgactgtggactttacccaggaggaatgggaacaactggacccctctcagaggatcctatacatggatgtgatgctggagaattatagcaacttactttcagtggaagtgtggaaggctgatgaccagatggagagagaccacagaaacccagacgagcaggcgaggcaatttttaattcttaagaaccaaaccccaattgaggaaagaggcgatctctttggaaaagcacttaatctgaacacagactttgtttctttaagacaagtaccttataaatatgacttatatgaaaaaactttgaaatataattcagacttgcttaatagtaatagaagctatgcaggaaagcagactgatgagtgtaatgaatttggaaaagcacttctctacctgaagcaagagaaaacccacagtggagtagaatattctgaatacaataaaagtggaaaagccctcagccataaagcagccatttttaaacatcagaaaataaaaaacttggttcaacctttcatttgtacttactgtgacaaggctttctcctttaagtcactcctcattagtcataagagaatacatactggagaaaagccatatgaatgcaatgtatgtaagaaaaccttctcccataaggccaacctcatcaaacatcagagaattcacactggggagaaacctttcgagtgtccggaatgtggaaaagctttcacccaccagtcaaacctcattgtacaccagagagcacatatggagaagaagccctatgagtgcagtgaatgtggaaagacatttgcccaaaagtttgaactcaccacacaccagagaattcatacaggagagcgaccctatgagtgtaacgaatgtgcaaaaaccttctttaagaagtcaaaccttatcatacatcagaagattcacacgggggagaaacgctatgagtgcagtgaatgtggaaaatcctttatccagaaactcacagctcatcatacacatgagaactcatacaggagagaaaccctatgaatgtactgagtgcggcaaaactttcagccagaggtcaactcttagattacacttgcgaatccacacaggagagaaaccatatgagtgttccgaatgtgggaaggcctttagcaggaagtcccgactcagtgtccatcagagagttcacatcggggagaaaccctgaaactccagccaggtcttactgtggaaaactcctgccagaactcttcaagcgggtgaaaaacctcatgacagtattgagggaacatgggaattcatactgagatgcaatctctcaactcaaaaatgtattaaaaataggatcccatgagaacattatactggaagttacatgtgatacccagctaaagaatacatatcagaatatatccagttgtaaatagccatacccagttgtactacaatgagctttttaaaatcttgaatgaattgagtattctagacagcagcataagaaatatacaaacagtatcctatgaatttagtggttttatgtggatatgccacaaaacacaagtggtatgctttagatctgcacatgtgaatttagcataatcactgggaatttgaaattcttgtcctctgtgataattaggacataacaagattttccatactaaacatcacatgtgtttttcagtatctctgcaatccagtatgcattccaaatgaaatgtgtaacatttaaagtagcatggaacctacgtctttccctactgcttgctggcatatatcagttggtatgaacattgttcttgagctgcctcttaggaaacag

SEQ ID NO: 28674 - DNA, 466 bp, Homo sapiens
tattgaattatttcactagcagcatcacaatattagtttcacagaatctcaaaaattaatatatttgaatataggtttaacatttcaaagatttttcaaaattctctcttcagctattttttaaaaatagtttttcaaataacttacaaaatgatatacatgtgaaaaactaggtgaaggtgctgggtgtggtggctcacacctggaatcccagcatttgggaggctgaggcgggcggatcacctgaggttgggagttcaagaccagcctggccaacaaggagaaaccccgtttctactaaaaatacaaaaattagccaggtgtgatggtggtgcatgcctgtaatcccagctacttgggaggctgaggcaggagaatcacttgaacccaggaagcggaggttgcggtgagctgagatcgcgccattgcacttgagcctggccaacaagactgaaactccatctaa

SEQ ID NO: 28675 - DNA, 298 bp, Homo sapiens
aatgtttttatttttagtagagacggggtttcaccatgtttgtcaggctgcttttgaactcctgacctcaagtgatccacttgcctcggcctcccaaagtgctgagattacaggtttgagccaccacgcccggccataaacatttttctttttggacaaaaataacattattatagacattttagaaaatacaaaaaaaaagaaaagcaaaattaaaacatattcctgagtgaacattttggtttatagtttttgagagttttccgtgtggataaaactcggtggaaaacaaaaacct

SEQ ID NO: 28676 - DNA, 995 bp, Homo sapiens
cccatgcctcaattggtttcttttagggagctacaaatttacgtgttcactggtgattgatcttttcatccagcacaatggacagaagtctaaggaacgtccttgtggtttcctttgggttcctgcttctctttacagcctatggaggtctgcagagcctgcagagcagcctgtacagcgaggagggcctgggtgtcacagcgctcagcaccctctatggaggcatgctcctgtcctccatgttcctcccaccgctcctcatcgagaggctgggctgcaaggggaccatcatcctctccatgtgtggctacgtggccttctccgtgggcaacttcttcgccagctggtacactttgatccccacctccatactgctgggactcggggccgccccgctgtggtctgcacagtgcacatacctcacgatcacgggaaacacacatgcagagaaggcgggaaagcgtggcaaagacatggtgaaccagtattttggcatcttcttcctcatattccagtcatccggtgtgtggggcaacttgatctcatcgctggtatttggccagactcccagccaagagacccttccagaagagcagctcacgtcctgtggggccagtgactgcctgatggccaccacaaccaccaacagcacccagaggccctcccagcagctggtctacaccctcctgggcatctacactggtacgagctccatcggcccagggcagggtccctagcaaagcagagccaagcctccttcctgggctgacaaagactgtctctcccaatgtaaaagtaatctctcttcttctgaaatatccttgcaaaatgtattggtctggattatatgcaggcggtgttcttatgaatcaaatgcagtacacccgtgctgtctaacagaggatcctggggtgatgagattgttatacatctccagagcccaacacagcagccattaagcactgtggttgtttacatcttaactgattaaagtt

SEQ ID NO: 28677 - DNA, 483 bp, Homo sapiens
ttgcattggcaagaggtgatcatactgctctcctactcctgccctttcctcctactccagctgaaaatacttggtgcaaatgtccttttataggagactttgaccccagggtatagaaaaggaaaggaaaaggtcacatatatatatgtcttgtctataactgaaacctaataccagcacaaaagcctaaaaggaccgatttttagagggcgttggcaggaaactctttgctctgctatcatctgttttaagctacttttatacatgatttattttttcagcttctactctgctactattcaactgcaaatgcaatttgttatattgtacacttcaacaccttgaacagcatcctaattattattgaaatgtattacgagttcgtaaagaaaacagcattttgtttcttcagtcatctacttaggatgaaagtgttatttagaaaacaataaatgggaaaaatgatacattaaaaaaaaaaaa

SEQ ID NO: 28678 - DNA, 759 bp, Homo sapiens
aactatatcagaggtcatcaagctacagcccatgggccaggtattcatttacatagtctatggctccttacctctataactgaagagtttaatatacagccataaaggttaaacatttactatctagccctttacagaaaaacttggccaacccctgactacatcaaatctttgccctctagtttttgttgagtgcagccaacattgagaacgtttactttggagcaatctccaattaaccaaagtgatacaaacacagtgatttgggaatgccttcaattacaatgcaatacttaaattttaatactcttgtaggagaaaaagcaactgtataaatgaatgtagagtgaatttctgcaatatttcaaacctgtatcagagaattacactgtgggaaaactaccattgtaataagtgtagcaaaatcttcttagatatctgaaaagtcatactggatggaatccagtgtccaatcttttggcatccctgggccacattggaagaattgtcttgggccacatataaaatacgtgaacactaatgatagctatcagttattgtggctcaagaaaattcttcttctggtgtagcccagggaagccaaaagattggacacctctgctttagagggagatgtaactatcaatgaattattatgttcattttttcccttagccagagaaaggccaaaagacattcccgtcagggtattaagaaatacattggtgaggagtttaccaccatccttggacaactctg

SEQ ID NO: 28679 - DNA, 646 bp, Homo sapiens
cctctcccaagattatacagctaccagttcaattcagcaaggcatatgtaaggctattaatattcaggacagaaaatttccactatgccacgttgctttagcaacataaaaaaagatggcaagcagggctaaattgactcagacttgaaagcaaaccaaataatcagaaaaccagcaggaatccgtgctggcatgatgtagtagtacagcctccttcatgggaagtgaggtagaatcacttgtgatgaagaagccaggatctgtagtcagattggtccaattcaccactgcttttgagaaatggaaactggataaattatttcgtagccttgggattcttatgtggaaaatagtggtaggagctattttaaatagtagggtcattataaagattacagcacataatctatgcaaaacacttagccctgcatttgacatataattagtactcaaataaatggtactaaaagcataacgatacattttatatttgttgatattgtcactaataaatatttcattctgtgcattctagttgttgacgagtcagttgacgtagcaaggtcataattgtggaaggtaatttcagtatttgtgagcatttgtattgacatgcttgtgtgcttattgcattagggaaaaagaa

SEQ ID NO: 28680 - DNA, 539 bp, Homo sapiens
tactaaacgtataagcaggacaaaattctggtataaaagtgacacactttggttgttggaaatgaacacaaattttagacttatgtgggattaaaggtaaaaatcttaccagtcatactttagataatttttagaagtcaaaggtggggtggatatttacttcttagtttaaacacagcattttaaaaatattttaacaagcaagcgtaactttttttttttaagatagaagaagcaggaaggatcacttaagcccaagagttccaggctgcagtgccacatcgtgcctgtcagtagccacttcagcctgggcaacatagcaagaccctcatgtctaaaattaaaaataaaatttaaaaaaaagaactacttctagttggttaataatcatgatagtttacactgtataatactttgagatacccaagtacaaagctttacatttgcctaaaaattccatttttgtctggtgttccatttttacttccaaaatcctaggaattaaagcacttattttccctacctccttccaactgaaa

SEQ ID NO: 28681 - DNA, 356 bp, Homo sapiens
tactaaacgtataagcaggacaaaattctggtataaaagtgacacactttggttgttggaaatgaacacaaattttagacttatgtgggattaaaggtaaaaatcttaccagtcatactttagataatttttagaagtcaaaggtggggtggatatttacttcttagtttaaacacagcattttaaaaatattttaacaagcaagcgtaactttttttttttaagatagaagaagcaggaaggatcacttaagcccaagagttccaggctgcagtgccacatcgtgcctgtcagtagccacttcagcctgggcaacatagcaagaccctcatgtctaaaattaaaaataaaattta

SEQ ID NO: 28682 - DNA, 381 bp, Homo sapiens
aaaactgttcacttgaattcctccagaagtaaaaggtatcttttagagtaaacgacgattgtcagaaacaaaaagaatgctagcgaaagactttgtccatatgtctattctagcactaccatgctacattgtaatttctgtttatgagtctattgaggtcaattaactgggcactctgtgaggtctagaatgatatttaatgtacttttatctccctgttggctattagagtgcctgaaacatagtagatcctcatattcaggaatgaaaggaaggtagttcatagggagaggaatagcaagataagcaaatataaattcggacacctatttgactagaattgaaagactgtagaggtcaaagagttgccaatcttatggg

SEQ ID NO: 28683 - DNA, 1006 bp, Homo sapiens
ggccagggggcggggctgggggctcggcccgccttgccctgaggcgctgggtgccttccagttggctgcgaccagcggtgacttacaagttggctgctgtcgcctgcgcatcggcgggccgggaggctgagcagtactgttgagagcggtgtgaggtgcttggtagcgcgccgtagctgcttccacgtccttgcttcacctcaggtaaagagagaagtaatggaaggcctgtctgatgttgcttcttttgcaactaaacttaaaaacactctcatccagtaccatagcattgaagaagataagtggcgagttgctaagaaaacgaaagatgtaactgtttggagaaaaccctcagaagaatttaatggatatctctacaaagcccaaggtgttatagatgaccttgtctatagtataatagaccatatacgcccagggccttgtcgtttggattgggacagcttgatgacttctttggatattctggagaactttgaagagaattgctgtgtgatgcgttacactactgctggtcagctttggaatataatttccccaagagaatttgttgatttctcctatactgtgggctataaagaagggcttttatcttgtggtaataatctcaacatgttatgctttttttcagtatggtttaaatatttgtgttttcttggctggatgtctctttccttgtgagatatattttcaactctgactctgtaatcactaacattttttgcaagtgctaaactctagggagtaaaatagcaatatcaaaagagttttgaaacccttctgataagtttttgttcccagttacacagtatcctctaggtcagaggtagccaatgtggatcacatgactgcctctaagaaagggttctagtaaatggatttccttctaagccactctcagaaaacagtttcttggtcatacacagagaagtactagatttggtgtgtcttagaatattcttccttccttgagctgtgttgtattttt

SEQ ID NO: 28684 - DNA, 879 bp, Homo sapiens
ggccagggggcggggctgggggctcggcccgccttgccctgaggcgctgggtgccttccagttggctgcgaccagcggtgacttacaagttggctgctgtcgcctgcgcatcggcgggccgggaggctgagcagtactgttgagagcggtgtgaggtgcttggtagcgcgccgtagctgcttccacgtccttgcttcacctcaggtaaagagagaagtaatggaaggcctgtctgatgttgcttcttttgcaactaaacttaaaaacactctcatccagtaccatagcattgaagaagataagtggcgagttgctaagaaaacgaaagatgtaactgtttggagaaaaccctcagaagaatttaatggatatctaattgctgtgtgatgcgttacactactgctggtcagctttggaatataatttccccaagagaatttgttgatttctcctatactgtgggctataaagaagggcttttatcttgtggtaataatctcaacatgttatgctttttttcagtatggtttaaatatttgtgttttcttggctggatgtctctttccttgtgagatatattttcaactctgactctgtaatcactaacattttttgcaagtgctaaactctagggagtaaaatagcaatatcaaaagagttttgaaacccttctgataagtttttgttcccagttacacagtatcctctaggtcagaggtagccaatgtggatcacatgactgcctctaagaaagggttctagtaaatggatttccttctaagccactctcagaaaacagtttcttggtcatacacagagaagtactagatttggtgtgtcttagaatattcttccttccttgagctgtgttgtattttt

SEQ ID NO: 28685 - DNA, 908 bp, Homo sapiens
ggccagggggcggggctgggggctcggcccgccttgccctgaggcgctgggtgccttccagttggctgcgaccagcggtgacttacaagttggctgctgtcgcctgcgcatcggcgggccgggaggctgagcagtactgttgagagcggtgtgaggtgcttggtagcgcgccgtagctgcttccacgtccttgcttcacctcaggtaaagagagaagtaatggaaggcctgtctgatgttgcttcttttgcaactaaacttaaaaacactctcatccagtaccatagcattgaagaagataagtggcgagttgctaagaaaacgaaagatgtaactgtttggagaaaaccctcagaagaatttaatggatatctagtcttaaagggatatgtgatcaaaagagaattgctgtgtgatgcgttacactactgctggtcagctttggaatataatttccccaagagaatttgttgatttctcctatactgtgggctataaagaagggcttttatcttgtggtaataatctcaacatgttatgctttttttcagtatggtttaaatatttgtgttttcttggctggatgtctctttccttgtgagatatattttcaactctgactctgtaatcactaacattttttgcaagtgctaaactctagggagtaaaatagcaatatcaaaagagttttgaaacccttctgataagtttttgttcccagttacacagtatcctctaggtcagaggtagccaatgtggatcacatgactgcctctaagaaagggttctagtaaatggatttccttctaagccactctcagaaaacagtttcttggtcatacacagagaagtactagatttggtgtgtcttagaatattcttccttccttgagctgtgttgtattttt

SEQ ID NO: 28686 - DNA, 445 bp, Homo sapiens
ggccagggggcggggctgggggctcggcccgccttgccctgaggcgctgggtgccttccagttggctgcgaccagcggtgacttacaagttggctgctgtcgcctgcgcatcggcgggccgggaggctgagcagtactgttgagagcggtgtgaggtgcttggtagcgcgccgtagctgcttccacgtccttgcttcacctcaggtaaagaaagatgtaactgtttggagaaaaccctcagaagaatttaatggatatctaattgctgtgtgatgcgttacactactgctggtcagctttggaatataatttccccaagagaatttgttgatttctcctatactgtgggctataaagaagggcttttatcttgtggaataagtcttgactgggatgaaaagagaccagaatttgttcgaggatataaccatccctgtggttggtt

SEQ ID NO: 28687 - DNA, 691 bp, Homo sapiens
cggaccttatattcttcttattggtttggagaaaacctcagaagaattaatggatatctctacaaagcccaaggtgttatagatgaccttgtctatagtataatagaccatatacgcccagggccttgtcgtttggattgggacagcttgatgacttctttggatattctggagaactttgaagagaattgctgtgtgatgcgttacactactgctggtcagctttggaatataatttccccaagagaatttgttgatttctcctatactgtgggctataaagaagggcttttatcttgtggtaataatctcaacatgttatgctttttttcagtatggtttaaatatttgtgttttcttggctggatgtctctttccttgtgagatatattttcaactctgactctgtaatcactaacattttttgcaagtgctaaactctagggagtaaaatagcaatatcaaaagagttttgaaacccttctgataagtttttgttcccagttacacagtatcctctaggtcagaggtagccaatgtggatcacatgactgcctctaagaaagggttctagtaaatggatttccttctaagccactctcagaaaacagtttcttggtcatacacagagaagtactagatttggtgtgtcttagaatattcttccttccttgagctgtgttgtattttt

SEQ ID NO: 28688 - DNA, 902 bp, Homo sapiens
ccaaatccctgtgacacaaattttctatataacaaacctgcacatgtatccctgagcctaaaacaaaaattttttaaaaagaagaaatctaactactttaaaatgttttataaagccttgcaatggctgattcctgcctatttttctacatcataccatgttattttctttcctcacacacgccacattcctggtacactagccacatttcagttcctcaaacccactctttttcttgaccttgaggcttttaattcgatgtttcttaacagtattctgccaggaagtattccttctgtactatttactgggaaaactccccttccttcaagggactgctgtcctcttaaatgtgggtttcctcaataggaccttccatggcccattcctcatgatcttccccacccctggcccactttggcaacatcccggattctaggatacttaaattgcattattgtcaggtcattaataaatacagggaccacaagggccctcaagatgtatgttcccttattaggaaccccaaaacaacaaacccaacagatattttaactatgaaagtccagtacagatttcaaaataattttgaataatcaaatttaatataaagagttatagtttcacaaagactatatgctatattttatcaccttaagtttctgtgagaaataggctttgttaatatgacgaaactctaaaattaatggattaaaagacacaatttctgtgaaaccccatctctacccaaaatcctcaaattagccaggcatggtggctcatgcatgtagtcctagttacttggggggctgaggcaggaggattgcttgagcccaggaggcggatattgcagtgagccgagattgcaccattgcactccaacctgggtgacacagtgagac

SEQ ID NO: 28689 - DNA, 519 bp, Homo sapiens
ctgatcatcagcccagaggtaaaccccggcatctttgggcttctcaccagttttggtttcctttccatctactgggctattccttcattttctacttcatcatcttcttaactcctcctactggatggggtgattatatggctttagtgcttagccattttccctattcatccagaagccctggcatcagtctggatgatttgatgtatcaaagctaatttccttattctctgctgtgatcctatcactgtggtttaaaataaagagcactggaccaagagttctagtcctgactttgcctttcttatccctatgatctcttcatgggctgggtatcaagtttactcatatgtaaaatgaagagactttattctcctcccccaccacagggattttgtgaaatctgcatgaaaacaccatagaagaggctgggtgcggtggctcacgcctgtaatcccagcactttgggaggccgaggcaggcggatcatgagaccaggagttcgagaccagcctggcc

SEQ ID NO: 28690 - DNA, 442 bp, Homo sapiens
ctcacagagtcgacattctgatggagggtgctaggagaagagagggaaagacaataaacatgtaaacaaataaacatggcatatcaaacgtcagattatgacttccacttctggctgtgaaaagccatcttgtagctgattaaccatcccacctaaaacactacatctgaaacataaagaaaacactggggagcagccaacttaggcaggcgggacttgatgggttacagtgctccagacagaaaacccagggaggaagctccacgattaccctggtttttccccgagcacattttccaaactgcagcatgcatgaaaagacttgaagctgaaagtggcagtcttagcaagtaaagggacaacagccagtgtgtagagctatcaaagtatcttgaacttgagggacaaaaccttagaaagtgaggaatcacaaacaaacaac

SEQ ID NO: 28691 - DNA, 360 bp, Homo sapiens
tccacctcctgggttcaagcaattctcctgcctcagcctcctgagcagctgggattacaggtgtgcaccaccacactggctaattttgtatttttagtagagatgggttttcatcatgttgttgttggtcaggctggtcttgaactcctgacctcaggacatctacccacctcggcctcccaacgtgctgggattacaggcataagccaccacacccaaccagaataatagatttcaaactgacagctctttatacttttcaaagcactcttactattcttttcgatttgatcctcttaaggcaaaaatgattaccttttttacaaatgaacaaactaagactcagagaggctaggtggc

SEQ ID NO: 28692 - DNA, 338 bp, Homo sapiens
ctatgtcacgctactgcactccagcctcggcaacagagcgagaccctgtctcctaagagggggtgaggagggagaaaaacaaaaacaaaaacacactgatacgtaaaatggaaaatgcctcccatctcttccagctccgccagtcacttctctttagaagtctttggtaactgctccagatttagaggtagctcaccccttccttgcaaaccagctccactcacaagaagaatcccgaattccatggaggcttcctggccagcctggaattccaggtaccttatgggattctggagcagtcctcagtacagggcaagatttttaaagtagatcaggca

SEQ ID NO: 28693 - DNA, 412 bp, Homo sapiens
gaatgtaaaacagttctcttgctaaaacctttggcctcctccagtgactgctctctaaatactccattttctgagagtgagaatagttaatgctcaaagatgctaaacaacagctgcagtctgcatcttctctctagagttgctgctcagcattgaatccagcctctaggctggaactcaagtaacctcgctgctttgaaaggtagctctggggaatattaaaaagtcaccaaacctcctgggactcatatgcagagacactttgtatatggaagcaaacaggatgaaaaaggctgcacagagcatgccatgcttctgacacattgtgggctccaatgtatggtctctgactgctatggtttcatctgagaggaaagcaaagaagagaaataaatgtttgttgagtgaatga

SEQ ID NO: 28694 - DNA, 349 bp, Homo sapiens
  misc_feature (187)..(187): n is a, c, g, or t
  misc_feature (189)..(189): n is a, c, g, or t
gaaattcctactgatattaatctaaaaattaaaaaagaaataggtagcaagaagagtagaagtatcaaaacagttggctttttttgcttttgttttttgagaaggaattttccttgttccctcccatgcctagctggattgcagagttaagtttatgattatgaaataaaaactaaataacaaaaananaaaaaaaaaaaaaaagaaaaatgcacagattttgatagaattaggaaagcactttgaccacatatatgttaaacttgatgataatgagatagagttcagctgtgtttaaagaacaaactatggagattacaataattcaaccagtgggaaatgggggaaa

SEQ ID NO: 28695 - DNA, 1578 bp, Homo sapiens
cagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcgg

SEQ ID NO: 28696 - DNA, 403 bp, Homo sapiens
ttacatgggatcatatatgggcaaagggcttggcacagaataaatatctggtaaactggaactatgacagtgggggcagaggtctgctgctccctgactatctccctctgccttagctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggtaatagcccttctgtgaccactgagcttcccccttttctcttcccaacctccagcctgacagccctctcattggtcccatcctcctccctgacctcatcttctctccaggttccccttttcctttgagctcatcctcgctgggg

SEQ ID NO: 28697 - DNA, 602 bp, Homo sapiens
gtatttgcaatcttggcggggagggtgggattgctgcagagaagtcggcacgtgttaaagctaaaattttcctttgttgcagttttattaaccatagcctatgccatagtgccacctgttgagtgctaccgatgggcattctggctggaagaaccacttgtccatagtgttaatagtgctctctattaatggtgttagattttaaaggtctcacaatgattgaagctcttcagagggtgagtgctccttatctgacatgcttgggaccagaagtgttttggatttgggagtttttttgaattttcaaatatctgcacgtacttactggttgagcaaccctaaactgaaaaatctgaaatccaaaatgctccaacgagatgacctttgagtgccaggtcggtgctcaaaagggttctgattttggagcccttcagattttggatttttggattaggaatggtcaacctgaatagccatactgtaactctaattgctttatttatttatttatttatttactgagacagagtctcgctctattaccaggctggagtgcagtggtgtgatctcggctcactgcaacctccaactcccgagttcaa

SEQ ID NO: 28698 - DNA, 414 bp, Homo sapiens
atttatgaaaatataaatctattttgactatgacttatacatgacaattgttgccatcaagtaggcaactgatgccctttacagtgtttagaacaaaactagtcctttatacaattttcatgaaaatgttaggtttctgtttgatcagcaggtgctgttgagatgaaagccatgtgtaaattttcagaaggccaaaagtgtcaattcagaaaaggaaagtgataagagaaaatgcaatcagttttcctgttttcaatttgtgcgggatttgaagagctgttttgttaaactgctacatctgctccaatatgaatattgaactacttccactaaaaataacaacctataatttggaagctactgcagtcttttgttaatgtgagtgggttatttaaaaacaaaaaaacaaaaaaa

SEQ ID NO: 28699 - DNA, 362 bp, Homo sapiens
ggaaaataaaacacagaaaaaaaaatcatcttattataagaacatactcagagctcaattactaaattacacttaaaattttctgctttaaatacgtgtcaaactatcaaacaaggcagagtggtttccagaaaatacaaaggcaaagtagacttctgtaaaaataactaaactattaatttataatgtatgatataataataaaatgaattttaagtaactgaagtatttactacctaataaaaattaggatatccaactatgaactaagttgcttaaaataatgtatgtgaataaattataagacaaattataaattaataacttctgttaatttactctgtgaacagatatatgagtac

SEQ ID NO: 28700 - DNA, 112 bp, Homo sapiens
taggccctggtggcccacttcagcgcccaggttttttgcctgctctggctggaggggcccctttctctttcttctgggcctttaatttgatgagtatacagtgtcacttcta

SEQ ID NO: 28701 - DNA, 353 bp, Homo sapiens
ctgtgtgtcacttctgctcatactccagaagtcagtcacatggccaccataattgccacagaagctggggaagttgaacagcacagaaagggaaatgggtttgataaataatttgccagtctttgccacataacctaaaaaataaagtatcaaggaaacaatacaatatatgtcccctgggaatttttgctgatgatgtgaaaacccctttgtcatcagagaattctcttattctcttttcctgttgcctctcccttttgttttatttctttctcctttttttttttttcagacaggatctagctctctcacccagactggaatgtggagtgcagtggcaccatcataactca

SEQ ID NO: 28702 - DNA, 445 bp, Homo sapiens
ggttcacacctgtaaccccagctactcaggatgctgagccggaagattgctagagcccagaggtttgaggctgcagtgagctatgactgcaccactgcactccagcctgggtgacagagtaagtaagaccttgtctctttaaaaaaaaaaaaaaaaaattgaactgagtgtcacagcctcaactttgccaccaatatttatagtgccttttaggagccagactctgggccaggactgggatgctacaaagaggaatgactctggctgggttaagggatggtatgggggagcaggaggcagggaaggaggaacacaatgagtggatgctgcctcccatgggctaaagaagccggggagggagtgctggccccagcctatcaagggagggacatttccggagggctccctggaggaggaggatacctgggctaagaaggttccacca

SEQ ID NO: 28703 - DNA, 794 bp, Homo sapiens
tcgcagcaaggtgaccaacagtgtgcaagtaataacccacgtgaaggaaaagctgcacttcatggacatggagaacgcgtgcaaaaagacacagctggcagaaatcgaggcccaggccgccctaggaagagacatcctgaccaagacgaagcaagcccgagaggggctgcggacggacaacatcagactgaatcagaagtgcggccttctaggcaaggactcacttcttcgggacttggaagaaaaggtggacaagaccgaactgcttcaccggcgcctggaatccctgaagcgccaccacgctagcctcactttgtcctgcagaggcgtgaggcagaagatcagggaggccaaagcctttctcccttcttgaccagatcgatgagaagagtctgcaaaacacttcatcctcaggacgtgctgtcctgctttattttaccttcgttgctattaaaaaggcctgtgtcatttgggacgggactctattttgtatttatctcaaaacgttttagcttccaaatcagtgctgagcccaaacctgggttaggagttttatctgggattgagcaaaaataggtccagaaaagcaaacaaagggtgatttaatgtaactgacttctcatgaaaaactgtcaaaagtctcaagtctgagcaattctataatttcagtgatgtaatactaaagagtactgttcctctttcatatgtaggagggtttaaaagttcagcgaatgggcaaggtacaaaaaaaccctgtgcattaagctaattattaaattctttggatttattaa

SEQ ID NO: 28704 - DNA, 284 bp, Homo sapiens
gccagggttcttctttttaaatgcatgctggctctacacagtgttgctttgaactaaaactgctctaaaattctctctaaaaaaaaaaaaaaaaagcatgctgtgtaagcatgcttaaagcatgatatagggagtcttgaatatcttctttttttcaaaagtatcctaagtcgaggccaaggtggaaggatcccttgaggccaggagttcaagacaaacctaggcaacatagcaagaccctgtctacaaaactaaaaattaaaaaattattcaagtgtggtggt

SEQ ID NO: 28705 - DNA, 6122 bp, Homo sapiens
cggaggcccgggcaggccggctgagctaactccccagagccaaagtggaaggcgcgccccgagcgccttctccccaggaccccggtgtccctccccgcgccccgagcccgcgctctccttcccccgccctcagagcgctccccgcccctctgtctccccgcagcccgctagacgagccgatggcgcggccccggagagcccgggagccgctgctcgtggcgctgctgccgctggcgtggctggcgcaggcgggcctggcgcgcgcggcgggctctgtgcgcctggcgggcggcctgacgctgggcggcctgttcccggtgcacgcgcggggcgcggcgggccgggcgtgcgggccgctgaagaaggagcagggcgtgcaccggctggaggccatgctgtacgcgctggaccgcgtcaacgccgaccccgagctgctgcccggcgtgcgcctgggcgcgcggctgctggacacctgctcgcgggacacctacgcgctggagcaggcgctgagcttcgtgcaggcgctgatccgcggccgcggcgacggcgacgaggtgggcgtgcgctgcccgggaggcgtccctccgctgcgccccgcgccccccgagcgcgtcgtggccgtcgtgggcgcctcggccagctccgtctccatcatggtcgccaacgtgctgcgcctgtttgcgataccccagatcagctatgcctccacagccccggagctcagcgactccacacgctatgacttcttctcccgggtggtgccacccgactcctaccaggcgcaggccatggtggacatcgtgagggcactgggatggaactatgtgtccacgctggcctccgagggcaactatggcgaaagtggggttgaggccttcgttcagatctcccgagaggctgggggggtctgtattgcccagtctatcaagattcccagggaaccaaagccaggagagttcagcaaggtgatcaggagactcatggagacgcccaacgcccggggcatcatcatctttgccaatgaggatgacatcaggcgggtcctggaggcagctcgccaggccaacctgaccggccacttcctgtgggtcggctcagacagctggggagccaagacctcacccatcttgagcctggaggacgtggccgttggggccatcaccatcctgcccaaaagggcctccatcgacggatttgaccagtacttcatgactcgatccctggagaacaaccgcaggaacatctggttcgccgagttctgggaagagaattttaactgcaaactgaccagctcaggtacccagtcagatgattccacccgcaaatgcacaggcgaggaacgcatcggccgggactccacctacgagcaggagggcaaggtgcagtttgtgattgatgcggtgtatgccattgcccacgccctccacagcatgcaccaggcgctctgccctgggcacacaggcctgtgcccggcgatggaacccaccgatgggcggatgcttctgcagtacattcgagctgtccgcttcaacggcagcgcaggaacccctgtgatgttcaacgagaacggggatgcgcccgggcggtacgacatcttccagtaccaggcgaccaatggcagtgccagcagtggcgggtaccaggcagtgggccagtgggcagagaccctcagactggatgtggaggccctgcagtggtctggcgacccccacgaggtgccctcgtctctgtgcagcctgccctgcgggccgggggagcggaagaagatggtgaagggcgtcccctgctgttggcactgcgaggcctgtgacgggtaccgcttccaggtggacgagttcacatgcgaggcctgtcctggggacatgaggcccacgcccaaccacacgggctgccgccccacacctgtggtgcgcctgagctggtcctccccctgggcagccccgccgctcctcctggccgtgctgggcatcgtggccactaccacggtggtggccaccttcgtgcggtacaacaacacgcccatcgtccgggcctcgggccgagagctcagctacgtcctcctcaccggcatcttcctcatctacgccatcaccttcctcatggtggctgagcctggggccgcggtctgtgccgcccgcaggctcttcctgggcctgggcacgaccctcagctactctgccctgctcaccaagaccaaccgtatctaccgcatctttgagcagggcaagcgctcggtcacaccccctcccttcatcagccccacctcacagctggtcatcaccttcagcctcacctccctgcaggtggtggggatgatagcatggctgggggcccggcccccacacagcgtgattgactatgaggaacagcggacagtggaccccgagcaggccagaggggtgctcaagtgcgacatgtcggatctgtctctcatcggctgcctgggctacagcctcctgctcatggtcacgtgcacagtgtacgccatcaaggcccgtggcgtgcccgagaccttcaacgaggccaagcccatcggcttcaccatgtacaccacctgcatcatctggctggcattcgtgcccatcttctttggcactgcccagtcagctgaaaagatctacatccagacaaccacgctaaccgtgtccttgagcctgagtgcctcggtgtccctcggcatgctctacgtacccaaaacctacgtcatcctcttccatccagagcagaatgtgcagaagcgaaagcggagcctcaaggccacctccacggtggcagccccacccaagggcgaggatgcagaggcccacaagtagcagggcaggtgggaacgggactgcttgctgcctctcctttcttcctcttgcctcgaggtggaagctgtatagagcccgggtccacggtgaacagtcagtggcagggagtttgccaagaccatgctccgcgtcggtggggctggccttgagaaggaactggacccagctctaccccgattccagcatgtgagcttcatgcttcctcaccacagaccagactcgcttcccatggtgggaaacagccaccgagaaggttctagctctagaaagggactaaacttattctctcatccgaagtccaaagaggatgatgaagccctgggctttgcctggtttgcgggagatttcctcccctcagtcaacccccataacctggggattgggcagtgtggaagaacgtgtagaccccagaatgaaacatggggttggagtggaggaggagctgtctcagcaagaggagacctggggctgtgcatctggatggaggcactcaggcctgggtaggattcctctggcacggagggagagaccctgggtgagacccctgtgagcatgggaagggcctgcagtgggcgcgggagtgagctgaggaactggggtgcgcccccatgagattcccaatgccatgggctttcccccatccccccgggattgggcaaggtcagacttagagtacagctgttttcctcccctctgtgtactcccttaaatcaccccaaccttggccaggcatggtggctcacacctgtaatcccagcactttgggaggccgaggcaggtggatcacctgaggtccggagttcgagaccagcctggccaatgtggtgaaaccctgtctctactaaaaatacaaaaattagccaggtgtgatggtgggtgcctgtaatcccagttacttgggaggctgaggcaggagaatcgcttgaacctgggaggtggaggttgcagtgagctgtgattgtgccactgtactccagcctgggtgacagagcgagactctgtctcaaaaaaacaaaacaaaaaaacaccaaaaaaacccccaaacctgaagaaattcagatacacgtgtgtaatgttagtgatgtgagaacaaggagcaggggtgcatttgtgttgtgttcgggttggggatgggtttaggagctccaggttgggagcagtgacagagagtcatggccgtggtgagggtgaatcccaagtggatggctcaggacgggtatggaaacccttcattcctcataggtactgggaagtccatttgcaagctgagcgccaggcctggggaggaagaggcttgggctgcagatgcacgcacatttgtttttcactgatagtttttacaaaaagcttggtttaagttatggaattttatgtccctgggagtagaatttacatttgttaaattgaccactgtttaagatcagtatacattctctagtctgtgatgtctggagctagttttgagggtgaaccacactttatccaacatacaaactttcccatgcagcttctctggtgcgcagttggttttgaccgtgggactaggtgcttctgcaggttttaagtaattaacttaaaagcttctcctctgagaaacatttctgttgcgctactgactctccttctccacatttgttgtgttcctagggcttctctatagtgcacattaggacgtttcatttgttgctgaatgctttccagaattatttattccatagggtttctctcctgtgcagctctctcatgggtaatggggcgtgttttcttgccaaaggcggttccaccctcgtgattgtatagggctcttctcctgtatgaactctgagatcagtgagctctgatctccaagggaaagttttcctgcatttgctgttttctcatgtctctcccagtgtgaattctctggcttctagctgaaaacttttccacagttttacattcatgtggttttctccactgtgaactctgtgattcagaatcagaagcagttcttagtagaggcatttctacactgattgcactgaggatatctccccagtgtgaagtttctggcatagagtcctggcttcccgcagacgactttcacactctgccatgttcatgcctgtgggcctctctggcaggaactctgatgcaccgcgaggcccatgtactcctgtggctttctcacattcggtctacttgcagggtatctccacagcatgcaccattctgggtacagggggacatcctctgttactgaagatgttgtcatatttagtaccttcacaaggtttctctccttccagaattttctgatgtacacaaataactgacttccacaagagggcttttccacactcggtgtgtgcatacagtttctgcctgtgatcatttctttatgttattattttattttttcgagatagggtcttgctcaatttcttaggctggagtgcagtggcacgatcatagctcactgaagtttcgacctgggctcaagcaatcctcccgcttcagcctcctgagtagctggtgcgcacgaccatacccagctaatgttttattttttgtagagacgaggtctcactatgttgcccaggctggtctcgaacttctgagctcgagcgatcctcctgcctccacctcccaaagtgttcggattacaaacgtgagccatcgcacctagcctctttgatcatttctgtggtgttcagtgggggttgacagctccctaaagattttcctgtttttttgcatgcatgggtttgaattctttgaggtccaatttatttggacccctgaataaagttttgtgggttttcttctatgtgtggaattatataggcattcttccagtgtggtttctcttatgtcgagtgagagctgacctgcaccgaagtttgtcccatttgttgcccttgaattatctgtatgaattatatgttccagtgaaaatggagttctgggttggaggcttattccatgtttacacaattaaaattgcagtgttcctctctgggatgagagctctaaagcagagtaagattacgttctgatgtaagctttaaccacctatttataaggtctcacctgtggtccactgtgttgagacttctacagaagagcttctgtatagtaaccattttcttaggctgtctcacttgtgtgaatcttctgacacatttattatagctttgtcccatttcttatcctttttgctctttagaaatttccctttaatttattacattcattgcttactgtaaagagtccaggtaactgactttaattcaagttacttcctgttcaataaatttaacttttccc

SEQ ID NO: 28706 - DNA, 1658 bp, Homo sapiens
ttcctctcccaggcccgagccatggcaacagcgtgacgtgggggtaccgagatctgcgggagcagcggtcccggcttcagttctagcctacccggcagcctggacgggagcaaggcgagaggtgctgccgcctcccgtcgcccctgcgctcagaggtcccgaaccagcccagccgctgcctcttgccgctccgcctttggagtgaggagggcgcagcccgcgtcagaacttagagggccaggcagggtcgcgcgcatggcctgggcgggctcgcggcgggtcccagctgggacgcgcgcggcagccgagcgctgctgccggctctcgctcagcccgggcgcgcaaccggccccgcccccaggccctctgccaccgccgcgaccaatgaggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtgaaaaaaaaaaaa

SEQ ID NO: 28707 - DNA, 1419 bp, Homo sapiens
ggggtcgctgcgaaccccggggttccgcggtggaggggtgctatactgggatgcaggcgcggcggggactggcagcaatcatgccctgggagctaacgtagagctttggataatgcttttgcaagttgtacgagaagggaagttctcggggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtgaaaaaaaaaaaa

SEQ ID NO: 28708 - DNA, 1526 bp, Homo sapiens
ttcctctcccaggcccgagccatggcaacagcgtgacgtgggggtaccgagatctgcgggagcagcggtcccggcttcagttctagcctacccggcagcctggacgggagcaaggcgagaggtgctgccgcctcccgtcgcccctgcgctcagaggtcccgaaccagcccagccgctgcctcttgccgctccgcctttggagtgaggagggcgcagcccgcgtcagaacttagagggccaggcagggtcgcgcgcatggcctgggcgggctcgcggcgggtcccagctgggacgcgcgcggcagccgagcgctgctgccggctctcgctcagcccgggcgcgcaaccggccccgcccccaggccctctgccaccgccgcgaccaatgaggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtgaaaaaaaaaaaa

SEQ ID NO: 28709 - DNA, 1609 bp, Homo sapiens
ctttttagtatattttgagcataatagctaaattatcgagcacttgctacatgctagcagcttgacttagatgttttacatagatatttctcatttaattctcacaacaaacctataaatcaggtgagaaaatggagacacaggtaatttacctaaggccacattgttaaaaaattgttaagagctgggatctgatccttgtgtgatcaccagtaaaactgacagcctctgttctccctagatggtccctcttaaaatcaaaataaacaatgaatgcaaaagcattctgtaaactgcaaaatataaggtaacagtatcataaggatttacacgtttgcttttgggaagttattcatccaggcttatttgggatctgtagttcctgaaggtgcgtggttagtgggcaaaggtatgaattaggggcctatagcaaggaggaacctgacccagctggcagctccttggcctgtgattcttcttctcctaggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtgaaaaaaaaaaaa

SEQ ID NO: 28710 - DNA, 1866 bp, Homo sapiens
ttcctctcccaggcccgagccatggcaacagcgtgacgtgggggtaccgagatctgcgggagcagcggtcccggcttcagttctagcctacccggcagcctggacgggagcaaggcgagaggtgctgccgcctcccgtcgcccctgcgctcagaggtcccgaaccagcccagccgctgcctcttgccgctccgcctttggagtgaggagggcgcagcccgcgtcagaacttagagggccaggcagggtcgcgcgcatggcctgggcgggctcgcggcgggtcccagctgggacgcgcgcggcagccgagcgctgctgccggctctcgctcagcccgggcgcgcaaccggccccgcccccaggccctctgccaccgccgcgaccaatgaggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggtgaggcctgtatgggagggattgacaagattttttgtttttagcagtttcatatgaaagtgctattttggccttccttgtaagtactttatgtccatgtgtcaagtatttccctcatatcagaaaagaaggaaaatggctttcaattcctttatattgtatcctatacttagtaatgttatttaactacctgattaccctattctaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtgaaaaaaaaaaaa

SEQ ID NO: 28711 - DNA, 1817 bp, Homo sapiens
ctttttagtatattttgagcataatagctaaattatcgagcacttgctacatgctagcagcttgacttagatgttttacatagatatttctcatttaattctcacaacaaacctataaatcaggtgagaaaatggagacacaggtaatttacctaaggccacattgttaaaaaattgttaagagctgggatctgatccttgtgtgatcaccagtaaaactgacagcctctgttctccctagatggtccctcttaaaatcaaaataaacaatgaatgcaaaagcattctgtaaactgcaaaatataaggtaacagtatcataaggatttacacgtttgcttttgggaagttattcatccaggcttatttgggatctgtagttcctgaaggtgcgtggttagtgggcaaaggtatgaattaggggcctatagcaaggaggaacctgacccagctggcagctccttggcctgtgattcttcttctcctaggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggtgaggcctgtatgggagggattgacaagattttttgtttttagcagtttcatatgaaagtgctattttggccttccttgtaagtactttatgtccatgtgtcaagtatttccctcatatcagaaaagaaggaaaatggctttcaattcctttatattgtatcctatacttagtaatgttatttaactacctgattaccctattctaggctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtgaaaaaaaaaaaa

SEQ ID NO: 28712 - DNA, 1515 bp, Homo sapiens
ttcctctcccaggcccgagccatggcaacagcgtgacgtgggggtaccgagatctgcgggagcagcggtcccggcttcagttctagcctacccggcagcctggacgggagcaaggcgagaggtgctgccgcctcccgtcgcccctgcgctcagaggtcccgaaccagcccagccgctgcctcttgccgctccgcctttggagtgaggagggcgcagcccgcgtcagaacttagagggccaggcagggtcgcgcgcatggcctgggcgggctcgcggcgggtcccagctgggacgcgcgcggcagccgagcgctgctgccggctctcgctcagcccgggcgcgcaaccggccccgcccccaggccctctgccaccgccgcgaccaatgaggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgctgtttgtactgatggcaagctcttcaaccacttagagactatttggcgattcagccctggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtgaaaaaaaaaaaa

SEQ ID NO: 28713 - DNA, 228 bp, Homo sapiens
atctactttctacttctgtggatttgcctattctggacatttcatataaatgggattatacaatatgtggccatttccttactccagtgcagtttttcccatttgcctcctttgtactgttattgtcaagtatattacatttctgtatgttatgcgtccaataatacaattccatacttattgtcctatgcagttgcttttgaaaacaggagaaaatatatgcattta

SEQ ID NO: 28714 - DNA, 432 bp, Homo sapiens
gattgccctttcattagcccggaacttggcacagtgtttggtaggagacgggcacatagtagtagctgaatgaataactacatagcattgagttaaagagtccatgcttaggagagttagggaagctgctacaatacagagatgtttgggcagagtgctatctcaaagactgggtgagccagcagtgaattcataaaagtcacagggttattacctaaccaatatgcaaatatatcccaggctaagtgaggaaatcatggctaacttttactgatcacacattatcctctagagacacacctttctcagctccttacatttatttcatttaatcttcacgacgactcaaggaaataggttattctgtttatttcataagtgaggaaatagaggcatagagaggtttattacctaatcccagcttacccagca

SEQ ID NO: 28715 - DNA, 527 bp, Homo sapiens
cagtgagcctagacagtgccattgcactccagcctgggtgacagagtaaggctctgtctaaaaaaaaaaaaacagaataagcctgagcaaaacaaaaacaaaaggaaatttattataaggatatgtgtatccagaagccaagccacgattacagctgggctgaagatttcccactggaaatcccgtgagaattcaggcagtattttctgtctatctattacgccattgcctcattcttctctctctctctgtctctttctgtcactgaagatcagagccttctacctactctgccttgtagaacatttaagcccacagttcccaagtttaaatgtttttggttcagtcacatatataactctttttttttttttttatactttacgttctagggtacatgtgcacaacatgcaggtttgttacataggtatacatgtgccatgttggtttgctgcaccatcaactcgtcatttacagtaggtattcctcctaatgctatccctcccccagcccccgaccccagacag

SEQ ID NO: 28716 - DNA, 460 bp, Homo sapiens
ggaagttttaaaatatcctcttgccttggctgcaccttataccaattaagtcagaatagatggaagtggtaccaacacatggcaatttttttctaatttttcagatgatatccaaatatagccatggttgagagccagtgttctaaatgccttgctccttaccattagtgcttgtatagtctttccatcatccccagtggtgactcagtctctacccaaacacacctagcattagctttgactgtcgatcaagttcttaggtcaattccaaatctgtcacttttctcttcagaataatctctttatttcttttaattgcttctcttatgacatgattttaaatctcctcattatcccagtagcattcttctaactagactagttgtcaatatggtatcttggaaagaatctggattttggagtcatagtacctttcatttacacttcatatctgctgtgt

SEQ ID NO: 28717 - DNA, 1216 bp, Homo sapiens
ctggcggctcttgggactggcggggctgcgcgcggggttagggtgggggtacgggaaggctcaacccaggacctgcgtaccttgctttgggggcgcactaagcacctgccgggagcagggggcgcaccgggaactcgcagatttcgccagttgggcgcactggggatctgtggactgcgtccgggggatgggctagggggacatgcgcacgctttgggccttacagaatgtgatcgcgcgagggggagggcgaagcgtggcgggagggcgaggcgaaggaaggagggcgtgagaaaggcgacggcggcggcgcggaggagggttatctatacatttaaaaaccagccgcctgcgccgcgcctgcggagacctgggagagtccggccgcacgcgcgggacacgagcgtcccacgctccctggcgcgtacggcctgccaccactaggcctcctatccccgggctccagacgacctaggacgcgtgccctggggagttgcctggcggcgccgtgccagaagcccccttggggcgccacagttttccccgtcgcctccggttcctctgcctgcaccttcctgcggcgcgccgggacctggagcgggcgggtggatgcaggcgcgatggacggcggcacactgcccaggtccgcgccccctgcgccccccgtccctgtcggctgcgctgcccggcggagacccgcgtccccggaactgttgcgctgcagccggcggcggcgaccggccaccgcagagaccggaggcggcgcagcggccgtagcgcggcgcaatgagcgcgagcgcaaccgcgtgaagctggtgaacttgggcttccaggcgctgcggcagcacgtgccgcacggcggcgccagcaagaagctgagcaaggtggagacgctgcgctcagccgtggagtacatccgcgcgctgcagcgcctgctggccgagcacgacgccgtgcgcaacgcgctggcgggagggctgaggccgcaggccgtgcggccgtctgcgccccgcgggccgccagggaccaccccggtcgccgcctcgccctcccgcgcttcttcgtccccgggccgcgggggcagctcggagcccggctccccgcgttccgcctactcgtcggacgacagcggctgcgaaggcgcgctgagtcctgcggagcgcgagctactcgacttctccagctggttagggggctactgagcgccctcgaccta

SEQ ID NO: 28718 - DNA, 421 bp, Homo sapiens
tatccttttcactttcttgataatgtcctttgcacaaaagttttaaattttgatgaggtcaaatgtatctgtttttttttcttccgttgcttatgcttttggtgtcatatctaagaattattatcaaattagggctgagtgtggtggttcacgcctatctctaatcccaacactttggaaggctgaggcgggaggatcgcttgagcccaggattttgagaccagcctgggcaacatagtgagatcttgtctttataaaaaataacaaaattagctgggtgtgatggcttacttgggaagctgaggtggaaggatcacttgagcccaggagggcttcagtaagccatgattacaccactgcactccagaacctgggcaacagagtgagaccctgtctcctaccccacccccgaccaaaaaaa

SEQ ID NO: 28719 - DNA, 219 bp, Homo sapiens
gtactgctgtggatgtttattaactcctccccaggtcttcgctttattttgtattactttagggtttccccatagtgtgttgcctgtttttgagacagggtctttctttgtcacccaggctggagtgcagtggtgcgatcttggctcactgcagcctcaacctcttgggctaaagtgatcctcctgcctcagcttcccgaggagctaggaccacaggca

SEQ ID NO: 28720 - DNA, 393 bp, Homo sapiens
catctaacattcactatctatgtgagctctctgtgggttacatttaaatctcaccactttatgaggtagatactattagtatcttcactttatagatgtggaaatgggacacgggttaaataactcggctaaggttacaccactagcatcaagaagagctagaagttgggtggtctgcctccagaacctggtatgtagcccctatgctgtgatgtgtgctaccatgtaaaccctccacgaatttacaaaatggttacaaaggccgggtgcagtggctcatgcctgtaatcccatcactctgggaggccgaggtgggtagatcacctgaggtcaggagtttgagaccagcctggccaacatggtgaaaccctgtgcctaccaaaaatccaaaaa

SEQ ID NO: 28721 - DNA, 2545 bp, Homo sapiens
ggcgggtggcgcgcgatcttcgcgtcgctctgggcgggcggccgcggcgccgcgctggtgggtgggatcgtggcggagcgccaggcgcccaaagaggggcgagaaagcgccatggcggcggcggcggctgtgtccggtgctcacgccgcggcgaggtgaggggaccgcctcttctccacaactgaggaggccacagctgccggcccacccgccttccacgcgggccgcggctccggcatggccgggatcattaagaagcagatcctgaaacacctgtcccggttcactaagaatctttccccagacaaaatcaacctgagcaccctgaaaggggagggtcagctgaccaacctggagctggatgaagaggttctacagaatgtactggagctgcccacctggttagccatcactcgggtctactgcaacagggcctccatccggatccagtggacaaagttgaagacacaccctatttgcttgtgtctggataaggtagaggtggagatgaagacatgtgaggatcctcggccccccaatggacagtctcccattgcccttgcttcaggacagagtgaatatggctttgccgaaaaggtggtggaagggatgttcatcattgtcaattctatcaccatcaagattcactccaaggccttccacgcttcttttgaattgtggcagctccagggctatagtgtcaaccccaactggcagcagagtgaccttcgccttacccgcatcactgacccctgccgaggagaggttttaacatttaaggaaataacttggcaaacactccgaattgaggcagatgctacagacaatggtgatcaggacccagtcaccactccattgaggcttattacgaaccaaggcaggatccaaatagccctcaaaagaagaaccaaagattgcaatgtgatatcctccaagctgatgttcctgttggatgacctgctctgggtgctgactgactcacagctcaaggctatgatgaagtatgcagagtcactgagtgaagccatggagaagtcagcccatcaaagaaagagcctggcccctgaacctgtgcagatcactccaccagcccccagtgcccagcagtcctgggcccaggcatttggtggcagccagggcaacagcaacagcagcagcagccgcctcagccagtactttgagaaatttgatgtgaaagagtcctcctaccatctgctcatctcccgcctggacctgcacatttgtgatgatagccagtcccgagagccaggtgtctctgccaacagactcatgggtggtgccatgcagcttaccttccgcaagatggcgtttgactattaccctttccattgggcaggtgatagctgcaaacattgggtacgccactgtgaggccatggagacccgaggccagtgggcccagaagctggtgatggaatttcagagcaaaatggagaagtggcatgaagagacgggtctgaaaccaccctggcaccttggagtagactctctctttcggagaaaagcagattctctttccagtcctcgaaagaaccctcttgagagaagcccctctcagggcagacagcctgcctttcagcctccagcatggaaccgcttacgctctagctgcatggtggtacgggtggatgacctggacatccaccaggtttccaccgctggacagccaagtaaaaagccatctacactcctttcctgcagtcggaaacttcacaacctccctacccaggtctctgccattcatattgagttcacagagtattacttcccagataatcaggagcttccagttccttgtcctaatctctacattcagttaaatggtctgacatttactatggatcctgtcagtttgctctggggaaacctcttttgcctggatttataccgcagcttggagcagttcaaagctatctacaagctggaagattcaagtcagaaagatgaacacttggacatccgactagatgcattctggttgaaggtgagctttccactggaaaagagagagcgggcagagttgcatcgtccccaggcccttgtcttctctgcgtcaggcatgattgccaccaatacacgtcatgctccacattgtagttgttcagacctccagagtctcttccggggttttgctgctgctgagttctttcattccaattatgatcactttcctaaggttccaggtggctttagccttctgcacatgctttttttgcatcatgcctttcagatggattcctgcctgcccccgctaaccggctttttgcccaaatgggccattatcgaagaattcacaaaaaacaatagcctcatcatccccaccatcatagccaccatcaccctccttaacctctacttctacctacgcctaatctactccacctcaatcacactactccccatatctaacaacgtaaaaataaaatgacagtttgaacatacaaaacccaccccattcctccccacactcatcgcccttaccacgctactcctacctatctccccttttatactaataatcttat

SEQ ID NO: 28722 - DNA, 652 bp, Homo sapiens
atcgtggcggagcgccaggcgcccaaagaggggcgagaaagcgccatggcggcggcggcggctgtgtccggtgctcacgccgcggcgaggtgaggggaccgcctcttctccacaactgaggaggccacagctgccggcccacccgccttccacgcgggccgcggctccggcatggccgggatcattaagaagcagatcctgaaacacctgtcccggtgagagcgccagcgccggcccccggcggtcctgggcccttcctaaccctctccgacctcctccctgacgccgcgctccgggcccagtctgcctctctccagcccggagcccggactccgtggcagcccctgcctaactcgagcccggacagcttccccccgcgcccgccggcgcccaccgttgtcgccgctctgtgcttcccccgcgctgggccctcctgtcctggcgccggtgccgctagtctctccccactctaacaaccccctggactttttctttcccctcaaggcccttctggcctgctgtccccacctcccacacctccaagcaggtcaccccgtgctcccttgaccgtctttccgaggcccccacgaagcccactcttgcctgcccgaaccagctgtcttctctctgctttctctggccttcgggcccc

SEQ ID NO: 28723 - DNA, 202 bp, Homo sapiens
tgcccttcagtgtaattgatttctgatgtgcttggccaacaaccatttaagcttttagaatcttcaagttattcttaaagaatcttaagcaaatctttaagcttttagaagaggaagaaaggacagggagatgagccttgaggtcactgcagcaataggcaggcatcaggtaatgagtcaccaggacagtaggaatggcagt

SEQ ID NO: 28724 - DNA, 741 bp, Homo sapiens
acttcagatagggattcatttgttgatattttctttcttctctcccctgctaacataaacacttttctgaagcatatagttatgatatcagcctttaaggtttattgtcccacaatggctgtggagttaaaaaaaaaaattcagtgagtttggatataagattattatttaatgaataatcataacataggaaaacatatcaaaacatagggaaaaccaacataaatagtcttcaaaagacactagttcttggtatattcacataaccacctttgtgaatgcagcacattaatacatctgtcatatagcactttaaaatggccaactttttaagtgcttttatactgtattctctccacaatgatgtgactttccaaaattttccactgaaaaagatgtaaccttgcaatgtggtttagtatggaacttactttgcactgtatctggcggttgaattttgcttttattgtactgtggacttgtgactaaggcaaataaaacttaagctcacttaatttaaatatctcaaaataacatttaggaaaaggtgcagtttttctttgcttcagaatgggtttttatcacaaaggaatgagtgagacatttatttgtgctgggacttctgcacagtcattgaatgctgtgagtgaatgttagtgaaaattcttgtcaagggaaacaagtttctttcaggatattctaccaaatactactgaaagggagaatgcagagcaaaacacc

SEQ ID NO: 28725 - DNA, 368 bp, Homo sapiens
ccttttatctttagatttaagtttttaggctatgactaggcctagctccaggcattgtcctttgttctggactttgcatctggtacataattaaaacggcttacctccaaggtttttcactaaaaataagagttactaaaagttaacattgtaataaatgtatataattgaaattactaaatacaagagaaaaaattctccatcgaaagtgtataagggaagtaggacatgtttttggtttaagaaaagttatcagaaggcatgaaaatgtggtttttgttaaaaggaaagtaattttgcctagtttaaaggttttttttttttaaattaaaggaataaaaaaaggacagataaaactacacaaatat

SEQ ID NO: 28726 - DNA, 565 bp, Homo sapiens
caaacaatcagcagtacttattttttagtcctgtgctcctgaaactacccttgaatatctctaacccctgatccactggggaggctgatttgagaggccagaagaacttgcctggcaattatgagtggatggaggaactgcctatccctgtcccattgtcttgtccacaggtcagcctcacaaagggaaagagccctggatgggaatacagtggaagctcattctcttagtgacctggggacattggctcgagatgaagcctggcaggagtggcaactccaggtttggatgcctaagaagagaggttttgagccaataaatgactatggggtgcttggaagccagtgagccctcacttctggtggaggagaggatgagcctgtggctgcggacacacctcatgtgaccctgatctcccctttgtgattgtgtgactctggctcagggactgtgtcttcctgtacctcagttttctgtcaatcagataagctaaatggcaaatggacagtggcttttcatgctatctgtgaataaatgttaaatgattcacagtcacctgacctaa

SEQ ID NO: 28727 - DNA, 968 bp, Homo sapiens
caaacaatcagcagtacttattttttagtcctgtgctcctgaaactacccttgaatatctctaacccctgatccactggggaggctgatttgagaggccagaagaacttgcctggcaattatgagtggatggaggaactgcctatccctgtcccattgtcttgtccacaggtcagcctcacaaagggaaagagccctggatgggaatacagtggaagctcattctcttagtgacctggggacattggctcgagatgaagcctggcaggagtggcaactccaggtgatttctgcacctttcctatttcctgggaggtgggccaggccacagtgttagtgggaagggaacagaacagccagcctagtcagagggagtttctggggaaggcctaggggtgggggaagaagctgtgcaggacagggcttgccagtcagaatgaagtgggaggaagatgagggacacagagaagcagaggcagatacaccatggcagtgagcagtgagggagacactgtcttcagaaactccagggaccaggtgcccccagttccatagtccaggaccaaggagccctcgagaacctccggtggccttaaagagcttcagaattacatgaggtggggtggctttaggggcaagaggtagtggggggatgaaacatggatgtccagcctctgaaggacaagggacaggtgtggctagaacctcctaggattctgcatccaagatccaatctctaaagaggttttggatcattcatttcttcattccattccttcatttgtcatgtgagagctcctgagtgtgtgtctctctcgctgggcctgtggtggtgtagagtgtgagtggggaaagaaaacaaggtcctctccttgatcctctcatgacagtgacaaggacactttgggaaacacaggatttcaggttcagtgatggtggttaagatctgaggaggaggcctggacattt

SEQ ID NO: 28728 - DNA, 640 bp, Homo sapiens
tgtggctagaaactcctaggattctgcatgcaaattcagtctctaaagaggttttggatcattcatttcattccattccttcatttgttatgtgagagctcctgagtgtgtgtctgtctcgctgggcctgtgctggtgtagggtgtgagtggggaaagaaaaggtcctctccttgatcctctcatgacagtgacatggacactttgggaaacacaggatttcaggttcagtgatgggggctaagatctgagggggaggcctggacatgttttttccactgactctgatggttgaggcaggtgatttagttctggagtacagactaatcagttgaccattttctctcactcctctgaggtttggatgcctaagaagagaggttttgagccaataaatgactatggggtgcttggaagccagtgagccctcacttctggtggaggagaggatgagcctgtggctgcggacacacctcatgtgaccctgatctcccctttgtgattgtgtgactctggctcagggactgtgtcttcctgtacctcagttttctgtcaatcagataagctaaatggcaaatggacagtggcttttcatgctatctgtgaataaatgttaaatgattcacagtcacctgacctaa

SEQ ID NO: 28729 - DNA, 96 bp, Homo sapiens
agtgatgggaggccggccccaggcttggggtgtgggtggtttcaattggaaaacttttataataaaaaattggaagaaagaatgtaattccctcta

SEQ ID NO: 28730 - DNA, 853 bp, Homo sapiens
ctgtctcaaaaaaaaaaaaaaaaaaaaaaaaattctcacagagggggatgggacttaagaaaaaggtttgttttctttaatgctcacagattctatttttaaatgacattttctgttttaattttttgaatgataatttttttttaatttcatcatcttcctgctattccttgtacatctgtttattgaggatgtgctgtgcatggtgttggttggatgctccacaatgtgtatatgcaggtacacggaacatgagctcctctctgaaagaggctatcatctagagcagagcagtttcctgtggagcttgtgaaaatacacatgcaagccccactgtgggagttactgacttattaggtctaaagggggtattaggcatctgttttttttttaaaagctctcggtattccagataccgcatccctcattgtagagcccacctagtccagaataggccccaacacaaaaacaaaaattccatggcaggccgcaggtagggagtaactgaaaggaacagtaattgcaaagtagattaaggaaggtttcctttagcattttgactggtcttcatgatgagtttcattttatcagagatttgaaagttgaacacttaagaagaagtgtatgggctaaagaaagctatggaaatatataatgtatttgtgggataataaaggagttttaattctgtataagcagaattttacagggcaagtagattcttgcttgggcaagctctggaaataaaactttaacagaaagtagcacattcattttggtactctttgtgttagaaaagcatgcttcattgttatatttgagggattttttaaacaccccccccccccaccaa

SEQ ID NO: 28731 - DNA, 201 bp, Homo sapiens
ggtgctctctgcgtagtagccagtaatgttggagcggccattcgtaaatggtaccaaagttccaaatgaagcatcattgctgaaatacatatttttttcaagtacaccatcacctaattcacatacagcatacgcacacatctggaaaatctgcattttcttcattggttgtatttaataaattgcctaaagtaccatttt

SEQ ID NO: 28732 - DNA, 536 bp, Homo sapiens
atagcttcagatcttaaagtcttagttcttcaaatgttcagaattcagcagggaagccagcaggtcctgggcttttctttgatgggggactttatggcttcaatgtcattatttgttattggtctggttttctgtttctagatgcttcaatcttggcaggttgtgtatgttcaggaaattgtccatttcttctaggctttccaatttgttgatatacagttgttcataatagtctaatgattctttgtattttggtaatctgttatgtcttttttctgatttgacttatttggattttctaaggaaaagtttcaattctgtcttttcaaaaagtcaactatttcatagatctgtgttttttagcttcaatttaatttattgctgctatttatctggggtaagatgatctcattgtagtgttttatttctttctttgattagtgatgttgaacatttcttttatattcctattggacatttgcatatcttttgagatgttcatgtcctttgcccactttttaatggattgtttttcc

SEQ ID NO: 28733 - DNA, 105 bp, Homo sapiens
caagctagaggcaaaaccaggaccctcactcccagcccactttaattcttccttcacaagcctgcctgtgactgcccaggtctgttctctgcttctaccaagggg

SEQ ID NO: 28734 - DNA, 493 bp, Homo sapiens
tagaaggaaggcttttcaatattgtcaccaaaaagaaatgataaatgcatgaggtgatggatacactacctgatttgatcattatactacatatacatgaatcagaacatcaaattgtacctcataaatatctacaattacatgtcagtttttgtttatgtttttgtttttttttaatttatgaaaacaaatgagaatgggaaatcaatgatgtatgtggtggagggccagggctgaggctgagggaaaatacagtgcataacatctttgtcttactgttttctttgggataaccgggggacttcttttcttttcttcttgggtattttattttctttttcttcttcttctttttttttttttaacaaagtctcactctattgctctggcaggagtgcagtggtgcagtctcggctcactgcaacttccgcctcctgggttcaagcgattctcctgcctcagtctcctgagtagctgggattacaagtgtgca

SEQ ID NO: 28735 - DNA, 381 bp, Homo sapiens
atgcctgaaccctctaagtctgctccagcccctaaaaagggttctaagaaggctatcactaaggcgcagaagaaggatggtaagaagcgtaagcgcagccgcaaggagagctattctatctatgtgtacaaggttctgaagcaggtccaccccgacaccggcatctcatccaaggccatggggatcatgaattccttcgtcaacgacatcttcgagcgcatcgcgggcgaggcttctcgcctggctcactacaataagcgctcgaccatcacctccagggagattcagacggctgtgcgcctgctgctgcctggggagctggctaagcatgctgtgtccgagggcactaaggcagttaccaagtacactagctctaaataa

SEQ ID NO: 28736 - DNA, 1579 bp, Homo sapiens
ctctaataattctgattcagtagatctgggatgtatcccaggaacatgcatttttagaaagcaactcaagcaagcctgatgcaggtggttcacccttgctccttttctgtgaaccacaaggataccagccataattccctgcatctgatgcccatcagcttagcttttattatcagaccatctgcccttaatttctagcttcttgggctgaccagatgattggttgtatgaaagggtgagatgggagtggtgagttgagccgccattgcatcttctagtcatcaaggttgtctactaattggcacacattttctcttagagatgtggttggttgtcaaaaggctgtctactctagagagtattctccaggaaggagaagcttccagttgtctaattagtaaagttatctaatctactaccatggagaatagatgtggttttgcccccaccacaagctgtaaaagccccaagctgggagggacgttgcggttgaggctattcagtctaatctcccgtgcatagtcctttcaacaacattcctgggagacagtcaggggcacacacattccagaacagttacatatcgtgtatttgaagaaggctcacacagccctggaaaccatgccactggccattccccatctgactcaggttacagatcccctcccttttcccactgaccactcactctcctctggccagatttgtttctgtttctctgaaagagcagttcccacaactgcatgaggcttttgatattggccggtgggtgaagagtacagagggatgttactatacttaatttgattcttcctctccccagcagccacatctgtccttggcttccattgagctttataatcagttgaaacttctgtgtcttctgacttgaacttctgtttggacagatctttctcaattgctgcaaatatgcacatgcatttgcatatgcatacacatacacacacatacgtgaagagcgttgtttctatccatgttacatctccttggaaattttagctaaaatttcccaattctgtgcactttgatttacctataaatctgatgaatttacccataaccaggtcagttataaaaatgtttagcatgtttccaaagacaagggtaagactatttttttaaaataagaaaaacattgtgctatataattgcaattactacattctatatgtaaaccgcttgctaaaactcttttaaaaagtgtttaaaattttcatttttgaaatgtgggccaactattccctttggaaacatgttgatgctgtctttttttcatgatccacagagagtaaagtggtgattggatttggtctctacttaaacatttaaaaaaataagtgtatcatagccaaacatgatctagttaccctctttattctaattgttccctcaaatcttatatgggctgtgtgactgctggctccttacatctaatctaaataaagaacaagaagggcattgcaacattgtggaaaaccctgtaacatgttttctcagctttcaggtatactagttccctgtccaacagtattaacattctgaaatccaatattgcttt

SEQ ID NO: 28737 - DNA, 433 bp, Homo sapiens
gaaatcttttgttctccaccatcctcttccttcctggctgatagatatctgaactgatagtgcaaatttacagtaagtataaaatattcagttcttcctgaactaaatgaaataattggacagaaatccaatttcttaatagaacttctgattataagccaaaattcaggaaacagctgctatcctgtaagaatgagaaaataagaagataaacaacccctactggtagattttttaaaagatactataattttaaaagaatagaaatcagattaattatttcccttgaaaaaagtaactgaagaaacatacagaaaaattagtttcaaatggacagaaaaactattttagaaaatttgtaaattattttaccaaattagagaatgtgcatttatgaatctaggatgagctaagattggtaagtaatatgtga

SEQ ID NO: 28738 - DNA, 1943 bp, Homo sapiens
ttcccatacaccagttaggttaagggacatctttagcttttaaaaaagtacagttcgaaatataaagtaaaagcagttaagtcttttccaagtacaaagtgaattggttccaattgctagagaatttacaaatatatattcacctgaggccagaaaaagctcctttggcctaggcctctctcctttatcaagctctctccatcacgagtgtgcacatgtgcgcgcacacacacacacacacacacacacacagaacttaacagcagtgatgtgtgttgtaatatgcaactttgtaagttacatatcactccccaataccaccttctcagtcacggagtagagatcttacttcacaagaagtgagactcagagaggtgaagtgacctgtgcaaggtcacctattacagtgccagagttggaactaaaggaacttcagtctgtgaacttcagtgtctttccagtagcatatttgcagcagaagagtcaagaatgttgtgagctgcaactctcactagaaccaaatgaccttattgggagatgttagtccagccttaaaaacaagctcttcacctccatgaatggcaagtgtctgccctcttcaggccaaatcgagaattacatctataactgagcaaatcctcagaacccaagtcagaccttggattattgcttttcagtaagttctggtcctggctgtgtctctaactcttgctgtgggaccctcagggaagctacccacccccttcaccccacctgaatgagatgatttctgaagtcctcagcagccctgattctaagcctcataaggaagagtaggtgttaatggcatcctagggcaatggtaggcgcctgatgcagatctgctgtgagccatgtgctggcatcacaggggtggtttattaatttcatttatcatctggacagccccttcttataacgtacatccttgcctcttctgaggctctaagatccccaaggtggctcctgtatccagaaaccccttggccttccctcccagttaagcaagatctctcttcaactcagggatgctgagagattgaaagtgaactacacacaggaacagccaagataggagttatttctatagcaccatgcttggctgatgttctttacacggagtgggcaggatttttaaaacagcgtttgtgccttttagcctgggctcctcctaaaagcagactctgggacaaggatttgtgtgcaagtagctggcttgaaaggtgattccaggaagcactgaggtggcatggagaagcaaggctgagaagaagggaatgcaaagaacagccaccaaggtgcacggccagggcctctgtcaagctgtgaggaacatgctgcagagttgtcccctggggctgaggaagctgtgagagagagccactccactcccatcctttgtaggtagagggccaccgccaggctcttagctacttggaactagggccagcttgaggaatatgggtgaggcacccatggcctctgctacattgtttttaatccagtctcaaaaacaaaatggtcctatcacagaaactctgcaaaaatacatgaaagagtaaagaaaaacatgtaaacattttacaattactctatccaaagataaatactgttaaaatgtcagtatgttcttacacaagtttttccatgcatatatgtgtagatttatatacattaagattgtattatacatagaaaataaatttctggacagttatataacctgcccttttcaaaatatatctaggaaatctttctatgttattgtgttgtcttctataacatgattttcatgactttactattatagtctctaaaaaggatggttcataatttttactggacatttcagtggtttgcaaagttcgactattacaatatatgttgaaatgagcatccttggatataaatcttttttgtacatc

SEQ ID NO: 28739 - DNA, 1912 bp, Homo sapiens
ttcccatacaccagttaggttaagggacatctttagcttttaaaaaagtacagttcgaaatataaagtaaaagcagttaagtcttttccaagtacaaagtgaattggttccaattgctagagaatttacaaatatatattcacctgaggccagaaaaagctcctttggcctaggcctctctcctttatcaagctctctccatcacgagtgtgcacatgtgcgcgcacacacacacacacacacacacacacagaacttaacagcagtgatgtgtgttgtaatatgcaactttgtaagttacatatcactccccaataccaccttctcagtcacggagtagagatcttacttcacaagaagtgagactcagagaggtgaagtgacctgtgcaaggtcacctattacagtgccagagttggaactaaaggaacttcagtctgtgaacttcagtgtctttccagtagcatatttgcagcagaagagtcaagaatgttgtgagctgcaactctcactagaaccaaatgaccttattgggagatgttagtccagccttaaaaacaagctcttcacctccatgaatggcaagtgtctgccctcttcaggccaaatcgagaattacatctataactgagcaaatcctcagaacccaagtcagaccttggattattgcttttcagtaagttctggtcctggctgtgtctctaactcttgctgtgggaccctcagggaagctacccacccccttcaccccacctgaatgagatgatttctgaagtcctcagcagccctgattctaagcctcataaggaagagtaggtgttaatggcatcctagggcaatggtaggcgcctgatgcagatctgctgtgagccatgtgctggcatcacaggggtggtttattaatttcatttatcatctggacagccccttcttataacgtacatccttgcctcttctgaggctctaagatccccaaggtggctcctgtatccagaaaccccttggccttccctcccagttaagcaagatctctcttcaactcagggatgctgagagattgaaagtgaactacacacaggaacagccaagataggagttatttctatagcaccatgcttggctgatgttctttacacggagtgggcaggatttttaaaacagcgtttgtgccttttagcctgggctcctcctaaaagcagactctgggacaaggatttgtgtgcaagtagctggcttgaaaggtgattccaggaagcactgaggtggcatggagaagcaaggctgagaagaagggaatgcaaagaacagccaccaaggtgcacggccagggcctctgtcaagctgtgaggaacatgctgcagagttgtcccctggggctgaggaagctgtgagagagagccactccactcccatcctttgtaggtagagggccaccgccaggctcttagctacttggaactagggccagcttgaggaatatgggtgaggcacccatggcctctgctacattgtttttaatccagtctcaaaaacaaaatggtcctatcacagaaactctgcaaaaatacatgaaagagtaaagaaaaacatgtaaacattttacaattactctatccaaagataaatactgttaaaatgtcagtatgttcttacacaagtttttccatgcatatatgtgtagatttatatacattaagattgtattatacatagaaaataaatttctggacagttatataacctgcccttttcaaaatatatctaggaaatctttctatgttattgtgttgtcttctataacatgattttcatgactttactattatagtctctaaaaaggatggttcataatttttactggacatttcagtggtttgcaaagttcgactattacaatatatgttgaaatgag

SEQ ID NO: 28740 - DNA, 339 bp, Homo sapiens
tctccaaacttgacatccacctatccaaatcctgctagtatcgagccaaacacttcctgttttgccctactaactgtactctcttttagttgtaaaagggcttaccactttgtaactctttgtgagcactgtctagatagctggttttacatatacagggtctgagagtcttatgaaaggtatggacacactcttcagagagaaaaatgtgtgtttttgtatatactcaggacagtctccttccacacctttctggatgtcttccatgtgtatgggccccagatgggtagcgtcagcctttggagaagcttatcagtaaagaatgattattagagcaca

SEQ ID NO: 28741 - DNA, 1877 bp, Homo sapiens
tcccataataccagcagtaagcctggcaacatgttcaacagatttagtacccaagaggaaatcaacagcgatagtagagaatgagtcagatgtagtgggataaatactagcctaggaagaaggagccccggagtctaatatgagctttattactaaattgctatgtgacgctaggcaagtcacttaacctctccatggctgtttcctcatctgtaaaataagtgtattggactagatgatccttagggtctttccaaaagtctaacattctatggcattataggttgccttgcaaattcagcctgctatagtgatggcaaatatcacgtttaagcctgagtctcttatgttgcagttaaataaaagaactatgtaagatgatttttaaaattcaagcaaatgggccgggtgcggtggctcatacctgtaatcccagcactttgggaggccaaggcaggcggatcacctgaggtcaggagttcgagaccagcctgaccaacatagagaaaccccatctctactaaaaatacaaaattagccgggtgtggtggcgggcgcctgtaatcccagctacttgggaggctgaggtgggagaatcgcttgaacccaggaggcggaggttgtggtgagctgagatcatgccattgcactccagcctcggcaacaagagtgaaacttcgtctccaaaaaaaaaaactcaagcaaatgaagttcataataataggggatgttgataaaacttgtggcagccttccaattcatttacagttgtttcgttttgtttttgttttaatgtccattttctgttgactgttcccagttttcattttccatacagtctgtatgtaaagtctggttttcattaagctgtggccagtatttgccactacaacagaaacacactgtcacacttgctagaatataactgtacttgggcttctcctttcctgtgaagtagtgctgggctttctagagtttaattctcaagtggcacaagatagcagagcccatgcattttaatggctgagactgctaagagtgaacctaaacacttacaagttgcagagagaaatgaaaaagtaattacatgctattagcattgagaaatgttgacaaattaatttgttggggaaccaaagatagcatttctgatgacaactcccacagtgattggccagttgtatgatgagtacactgctggaaagagggtaaactgggagttagtggatggtcccaatgccctgcctacagcagagtgccaaccagccctgagtgcaaaattcaagttcaatgtgtgtgcttgtgtgtggtgtgctttatggacccgcaaataccatattcattattgatgataagatcttcacagaatcctgtagctactaatgcattgagtttttaatctcagtacatcagccaggaggagccagatcacagggtagtgatgtctactgggattatactcataacatctacacaaaacaagttgagaaggatccacgttttcattgtttatcagaattgtatctcatttggctgagcattacttttgtcagaatgtgttatctgtaaaccatgtgtagtgaaattcttctgtaactttggattaaaggtatttatggtctttttgtttgtttgatttttaagtaagttatttcttttgtagacctgctgatggtatggttccatccttctgacctcagcatccaatctttttaaggatttttgttttcaatattgttattttaaattgtggttgaagcaatagaaaattgaaatatggattgtgcatgactgtgtcttgagtgtaaaaatattgcagtttgaaacttggacctaaagtattgcaaataaaaatgacaaacatcaatgaaaaaaaa

SEQ ID NO: 28742 - DNA, 1251 bp, Homo sapiens
atgtcatctccctaagccctcatctccagcctcggcaacaagagtgaaacttcgtctccaaaaaaaaaaactcaagcaaatgaagttcataataataggggatgttgataaaacttgtggcagccttccaattcatttacagttgtttcgttttgtttttgttttaatgtccattttctgttgactgttcccagttttcattttccatacagtctgtatgtaaagtctggttttcattaagctgtggccagtatttgccactacaacagaaacacactgtcacacttgctagaatataactgtacttgggcttctcctttcctgtgaagtagtgctgggctttctagagtttaattctcaagtggcacaagatagcagagcccatgcattttaatggctgagactgctaagagtgaacctaaacacttacaagttgcagagagaaatgaaaaagtaattacatgctattagcattgagaaatgttgacaaattaatttgttggggaaccaaagatagcatttctgatgacaactcccacagtgattggccagttgtatgatgagtacactgctggaaagagggtaaactgggagttagtggatggtcccaatgccctgcctacagcagagtgccaaccagccctgagtgcaaaattcaagttcaatgtgtgtgcttgtgtgtggtgtgctttatggacccgcaaataccatattcattattgatgataagatcttcacagaatcctgtagctactaatgcattgagtttttaatctcagtacatcagccaggaggagccagatcacagggtagtgatgtctactgggattatactcataacatctacacaaaacaagttgagaaggatccacgttttcattgtttatcagaattgtatctcatttggctgagcattacttttgtcagaatgtgttatctgtaaaccatgtgtagtgaaattcttctgtaactttggattaaaggtatttatggtctttttgtttgtttgatttttaagtaagttatttcttttgtagacctgctgatggtatggttccatccttctgacctcagcatccaatctttttaaggatttttgttttcaatattgttattttaaattgtggttgaagcaatagaaaattgaaatatggattgtgcatgactgtgtcttgagtgtaaaaatattgcagtttgaaacttggacctaaagtattgcaaataaaaatgacaaacatcaatgaaaaaaaa

SEQ ID NO: 28743 - DNA, 562 bp, Homo sapiens
  misc_feature (12)..(12): n is a, c, g, or t
  misc_feature (43)..(43): n is a, c, g, or t
  misc_feature (55)..(55): n is a, c, g, or t
  misc_feature (71)..(71): n is a, c, g, or t
caagaaagcttntggacaagcttactggacttttaaccgggtngaagagaagctncttgaggtgggcagtntgaccttaccaggaggaggccgcccggcacacataccaggcactcaactcgctgctagtggctgagctcccacagtttaaccagctggtcatgcagtggctgggccagatcctgtgcacattcgtgaccctccagagggaccttgcaaagcaagtgctgcagagggcagagggaagcatggcccagctgccccaccaccacgtcccagagcctgccttcaggaagctggtggaggacgcactgggccggacgagtaaccagcttcgctcctttcaagagacctttgagaaagtgcagccacctcccaccacacaaccgctccttccagggtctgaacgccaggtgcaggctctcctgagcaggtatggccctgggaagctgtaccaggtgacaagcaacatcagtgggactgggactctggacctgactctgcctcggggccaaatcgtggccatccttcaaaacaaggacaccaaaggcaacagcggccg

SEQ ID NO: 28744 - DNA, 451 bp, Homo sapiens
gcaagagatcctgcacagggtcaaggtctcaggacagagtatcactcagaactccttgggttgaaaataatataaacccaaagcaagccagggatctcattgtcccctcttgcccagctctgttgacagtgtctgtccccacttagctgccccaccaccacgtcccagagcctgccttcaggaagctggtggaggacgcactgggccggacgagtaaccagcttcgctcctttcaagagacctttgagaaagtgcagccacctcccaccacacaaccgctccttccagggtctgaacgccaggtgcaggctctcctgagcaggtatggccctgggaagctgtaccaggtgacaagcaacatcagtgggactgggactctggacctgactctgcctcggggccaaatcgtggccatccttcaaaacaaggacaccaaaggcaacagcggccg

SEQ ID NO: 28745 - DNA, 406 bp, Homo sapiens
cagtaactgagagatttcagaacttgaattggaattttagagaatcccagaaattagaagtttcttccaaaacgccgtaggctgctaagagccagccatctgctagtgagggccctgttgccctgatcagggtgggcccttcagtggcagagttaggatcaggcccagtactcctggctgtcaaaatgtgagcaaatgttggtgccagctttgacaggtttattcaagcacttgtgtctgtctgtgctcctcctctcccagccgctccttccagggtctgaacgccaggtgcaggctctcctgagcaggtatggccctgggaagctgtaccaggtgacaagcaacatcagtgggactgggactctggacctgactctgcctcggggccaaatcgtggccatccttc

SEQ ID NO: 28746 - DNA, 424 bp, Homo sapiens
gtgattcccctgcctcagcctcccaagtaggtgggcttacacacacgtgccaccacaccgggctgattttgtatttttagtagagatggagtttcaccatgttggtcaggttggtcttgaactcctgaccccaagtgatccactcacctaggcctcccaaagtgctgggattataggcataagccaccacgcctggccataatcccctacctttaactattgtaggtcagcaaaattttactgaaatctatcaaacataattcagtgattgtgaatgaccaattctataatatgcaacattattccactcttacatccccaatcattggactttacaggtatttttagcctgaatacacaatgtgctacttattatagaaatagatctctcatctttctctttcccacagtaatttagctatcc

SEQ ID NO: 28747 - DNA, 435 bp, Homo sapiens
tctccttatcatgctactttttttctccaaattcctgagtgtatggaacatactttaaatagcagtttcaatatttttgctactaattccatcatctctgtcatttctggatctaattctactgattgatacttttttctttttgctttctgtttgtttgtttttatcacctgacattgagtatgtactattgattgatttttctactgtttgcagatcatattttcctcctcctattcatttcaagtaattttttgtggcatgctaaacgttgcaaattttacattattgaatgtcgcattttattgaattcctttaaagagcattagattttattctggcatgcagttaaattacttaggattggttttatttttatttttatttttaagaggcagggtctcactctgttacccaggctggagtgcagtggca

SEQ ID NO: 28748 - DNA, 390 bp, Homo sapiens
tcctaatctgaggtggctctctgtaagcccctgaacaatgtcagggtgggggctgattgccaggaagaccaaaccatgattagaagcttaggtctttcagccccactccccatgctccagagagacgagaggagctggagactgagttagtaatccgtcaagcccacgtgatgaagcagccataaaaatccctaaaaggcaaaatgggagaacttctgggtcagtgaacgtgtcatgtgttggaaaggtggcacgaccgaagtccatggggacagaagctcccgtgctcacgccctctggagcttgccctacatgcaagatcttcatctggctgttcatgtgtttattctatcaagtcctttgtcataaactggtaaatgtgagtaagtc

SEQ ID NO: 28749 - DNA, 351 bp, Homo sapiens
cggaaggccttttctacttaaccagagcacagaacatgtacaggagagcatcacaaggctgaatggaaaaccagttcttgtggtcattgatgactaaaataataaatgtctttagaaaaagcgacactaagaaatgcatgttttgtgttaaaaattctgctctagagctttataaataattttaaagcttctggtgctcagtgttctcctttgaggaatacgggtttatgtggttcatctcccttagtccccactgcagctaggggaaaagtgggatgctctcatcccatctcaccactgaacatggagccactgcttgggctaaatccgtcttttacaaattttttcccc

SEQ ID NO: 28750 - DNA, 726 bp, Homo sapiens
tttggggttctaaactgggaagtttctagaagaaactgaggagactgttgctgtaggctgatcccaaaggattgacacaaatggaagaaattctactttagcaggaaattgaatggattaaatgtagagtacggagactccttgatacttttactttcatgatttattccaccttttttggtctgatgaattgttacttatggtaaatgcctgcactactgtataaagtgtcctatcgtagttgttccaaagaaaaaaaactcatttgaactccaaagatagacattattctctgtcttttttaaaattcatttaaaaaaatattagaagccacaaaaccaataaataggtaacaattattctatgtacattaactgatagtccatgtgggcttctataacaaaataccattagttgggtaacttacaaacaacatatttatttctgtaggctgggaaggccaagatcaaggcagatttgttttctggtgagggtctgcttcctggttcatagatggcaccttctagctgagtccttacatggtggaagggaaactgtggtttcttcagcttcttacaagggcactaatcccattcataagggctccaccctcatgacctaatcacattccaacatctccacctcctatgctatcacattaaggattaggtttcaatatatgtattttaagggaagataaatacctgggccttaacaactgatgaa

SEQ ID NO: 28751 - DNA, 416 bp, Homo sapiens
gagtctagttgaaagaagaggaaccaaagaaggaggagggtaaggggtttggtagcaagaaaacaccagaaaggattagagctttagtcgtattcccagcaacagaatgctacagtgtaaaataatgttagtgttctatctccaatatgtatatacatagtttacacctaaaatttcctctgttagatttaatgtgctagaacagcaagtacagtacagaaatacaatggaacaaagagatgttgccagaggacaaaaatgtgccgaagagccagggctctctcagcattgtgtccttgaatggtaacagaaaggagttaaagttttctcaaggacaaagaagaaatgcaacacctctcttcattgcaactcattttgtcaaagcttaagaaaataaagtctgattactgcaagac

SEQ ID NO: 28752 - DNA, 345 bp, Homo sapiens
ttttttttttgagacgagtctcactgtcacccaggctggagtgcagtggcacaatctcagctcactgcaacctctgtcacctgggctcaagcaatcctcccgcctcagcttcctgagcagctgggaccacagggacacaccagcatgcccagataattttttgtacttttggtagagtcagtgttttgccatgttgcccaggctcgtcttgaacacctgggtcttgagctcatgtgatctgcctgcctcagtctcccaaaatgctgggattacaggtgtgtgccactgtgcctggccaagatggtcactttcggacctctcaaaccccaaaccagagggccaacc

SEQ ID NO: 28753 - DNA, 713 bp, Homo sapiens
gtatctcaccatggagaaattaacccaaaacataaacgcaaggagctgctgtccatgacacgcacagcgatgcgtttagtgggaatgtggactcatatctgcagcttgctttaaatgcaccccaaaatcaatggattggtggacggagaaacaacagaccatttacagcacctaggtgtgggtgcataatgtttctgcatgtttgaaaacgctcataataaaatgttggtaaagaaaagaaatggctaaaagtaacctaaaacggactcggatccattgcttgatttgtggagatgccctctgcaaccttagaaaggcgcctttctccactgcctccggacagctctgccccagcctgcgtgcctgagctccagggcagtccagtccatgcacatgttgatgctctgattcattctggcccccagcagtccccatgtcacatgtgggtttataaggcagaagctcagaggctccccttcgcctagctggtgttagggtttccagcaggaaggtattggtggtggtttttgttttaccagggagacatttttccttctggtggtcctcgttcctgtaactcttgcaactttgtgtgatagtttaggatgatcagtaagtgaagctcacccctcctcccatccccttttcatgggaactgttcagattcagtgggtttttagttggctttagccatggaagaagtaaatacaggc

SEQ ID NO: 28754 - DNA, 451 bp, Homo sapiens
gatggtcttgaactcctgacctcaagtgatccacccacctcggcttcccaaagtgctgggattataggcgtgaggcaccgtgccttgccgataaatggattttaagctgagtctttgagggaagagtaggacctgcactgaaacaaaaagacaatttgtggggttggggagaggaaccagatgtaaacaatggaaaggttttggtgtcactttgagaaggattttttggaagggttttgcaatgtccattctgtatcttgggttaacactagtaagtcaaatggagaataatttgagtgtcactcattcctacagatagaaaaattttaaagtagcttgggccgggattttccttttatcatgtgccattgtgtacgtgtctgctacttcatttagttccttttttaaaaatggaatttttatcacttctgtgcaaaggttaaattttttt

SEQ ID NO: 28755 - DNA, 454 bp, Homo sapiens
ccaggccacacgcgtgctttgcccctactgcttgggttcatcctcacgacccacccttagcgaggaagagcggtcatctacccacttcacagatgcggcaactgaagacccgagacggggagagagctgctacaggctcgagtgaggagatgtggtgggccccatgggagaatctggcttccacccgtgaatccgagcctcggccacggtcgccactcgcccttacccacttccacgctgtagtgcgaccagccacccgcgtggcattcgccacgacccagctgggttcacagacaggagctgcctcctcccactgcaggcgggtgacccaaggcccccactgccctatacctgcccagatcgcggggcactcgggctccgcagctctctggccgcgctcggggtccggggagccgggctgcggctggggggcctggaggatgagggcgaagac

SEQ ID NO: 28756 - DNA, 909 bp, Homo sapiens
gtttttaacatctggatttaggctaaaaagctgcttcctggcctcagggcgcaaggccacaacagctaaatatacctgtttatttccctcaagaggccaacttggcatctcctcagacccagccgcctgccactttcatactcagtctctggcctctctggaatcatagccccaccagacctgggacagctctgcctcaggaggccagcagtccctgccacctctctctctgtccttccgtcagctgtaggcctggccccacttaacctcacagacatctggggtagagttgccagatttagtaaataaaagtacagggctcccagttaaatttgaatttcaggtaaacaatgagcatttttttttttagtacattatgtctcatgcaacatttgagactgacttatgctgaaatagtacttgctgtttatctgacattcaactgtaactgggcatcctgtattttatctggcaaccctgatctggaagaataaagcagagctcgaggaagaggacagcctctcatcctgctcaggtaatagagaagccgaggctggatccaaaggcagccatggtccctatagtagaaagagcataaacttaggagttgagccaggttagaacctcagcttggcagctcaaaactgaggaccctggggcaagtgccttctcggttctctcatctgtcgagtgtgagaaatcagacctgccttgcagagctattgagaggattcattgacaggaggcccctaaagtttgtttagtatgtgcccaggtgtgatgacagtgcttcttgtgatttcacctggttctctacccaccagtcctccagacatgctggagggcagggctatcagttcatgatatagggcaatgccttgatcctctgccagcctccttataagccca

SEQ ID NO: 28757 - DNA, 223 bp, Homo sapiens
ttgctttgcaggcctcccctccctggctggctctggtctgggccctgcacacgttggggaggcccaaagacaacccagaggagcctggcataaccagcagggctcagcatggatgggactggggtaaaatcagggcttctgagcatgactccaagagtgtgaggtccccagagaaagtggcttagggaggtagtgggatgtggagagtgaaacactcttcaga

SEQ ID NO: 28758 - DNA, 1108 bp, Homo sapiens
agtgagatttgaggagtccctgttgttctgcaacatccctagattgaatgatctgttgcagatggtggataccaagttcaaatttaaagatttctttgtaagcagtaaagtgactttcacttatttaacttagaactggaaaaagtaacttttttccagattacattttctgtatatttgtaaaatgcaaaagcaatatatatttgttgtgagaaaattagaatatacagataaaataaaatttaaaaaaacacccaaagataaccagaagaaaatttttgctatgtaacctttttcttctggtctttgcaaatcctgccgtagaaactttttaacttcaggagtgtccttcctttgctctattaggacattacagaaaccaatactatgaaaagctgacagcagtatctggattaactttttaaaaacaatgaaagcattttacagaaattacatttcagatcgtgctggaactgtgttcagaagatatcctcagagggaatctggcctgagcaccatcatgtttaattgcctcctcctgtcttgcattttcctcccagcccccttcctaccccttagcagagggccaggtgagggtgcttggggcccatgggggctgggagtgtagacttcagttacacccccagcccccaggggaaagcattagccttgaatcctcaatcccaggccctctactaaccactctcaacctatggtatttatcttttgattattctgtgcatctataaaaatgggattatattgtacagaatgctttgtaagctttctctccccacataagaatgccctgtaagcattttgttaaatatttttaatgactttagagtccaactttatactcctctttatgcattttggttttctaatttaatggtagtgtaaacgtttttggaataaacattcctgtggctaaatctttgcatacttcttgtattattactttaagatgtttctaagaagtagaatgactgaatcaaagagtgaacattttaaaatatcttaaaatatacatttggtaaataatgtatacactgtagaaaaactggaaaatagatgagcagacagaataaaatgtaaattacctgta

SEQ ID NO: 28759 - DNA, 1040 bp, Homo sapiens
  misc_feature (628)..(628): n is a, c, g, or t
agtgagatttgaggagtccctgttgttctgcaacatccctagattgaatgatctgttgcagatggtggataccaagttcaaatttaaagatttctttgtaagcagtaaagtgactttcacttatttaacttagaactggaaaaagtaacttttttccagattacattttctgtatatttgtaaaatgcaaaagcaatatatatttgttgtgagaaaattagaatatacagataaaataaaatttaaaaaaacacccaaagataaccagaagaaaatttttgctatgtaacctttttcttctggtctttgcaaatcctgccgtagaaactttttaacttcaggagtgtccttcctttgctctattaggacattacagaaaccaatactatgaaaagctgacagcagtatctggattaactttttaaaaacaatgaaagcattttacagaaattacatttcagatcgtgctggaactgtgttcagaagatatcctcagagggaatctggcctgagcaccatcatgtttaattgcctcctcctgtcttgcattttcctcccagcccccttcctaccccttagcagagggccaggtgagggtgcttggggcccatgggggctgggagtaaanaatttaaatgcggcaacaactcccaaaaaattgatggggcgtgcacagtcaaaacccccaaaaatgactccttgtaaaatgtgtttgtgcttatttaaattaaaccacaaggcccttccctgaacaccctggctacttacacacacttacattgaaatccgggtgcacacagattagaggggtgggactttttcgttcttaaaattatgtccaaagggttttcttttcttattttccagggagttgggttttcttggaaaagtcttttcttgggagaaacaggcggtttttctccacccagtgttgatacatttcggacccgccggaaaaccaatttttgtgggcgatacaaaacaggctgggtttacttttaaaatattaacggtataaccgctttactttaacaggtccg

SEQ ID NO: 28760 - DNA, 375 bp, Homo sapiens
ctgaaatcagagatgggctctaccactgctttaatatgcgactttagtaacccactgattctgttgtagaattcttggacttgaagtactgttagttatcatttttcagtccagatagtattgcatcaaacaaaattatgaaatatatacaaatttgagacattatgagcagaggcattgatgaccacatgctatatcttaaaattttactgatagttgattttagcaagtcttatgaaacactaagaacaatgtctggtgcctagcaaattctcagtaaatttcagctagtattattacagttagtattactttactatgctccctggataaaatttttataattaaatggttaatgactttccattgaggtct

SEQ ID NO: 28761 - DNA, 210 bp, Homo sapiens
acctttccttgtgtttactttcctctttaattcttgctttcttttccaagtcttatcaatatatgctacccacatatttgtgtctctgtagcggtgtggaatatagaaaggcaggagctcagaagtctctgaaatcagttcatgggttaaaacccatgaactttggtaagtacattgacctccttaactctcagtttcctcatctgttaa

SEQ ID NO: 28762 - DNA, 403 bp, Homo sapiens
ttttttcttttgagatggagtcttgctctgttgcccaggctggagtgcagtggtgtgatctcggctcactgcaacctccgcctcccgggttcaagcaattcttctgcctcagcctcccgagtagacctgggactacaggcgcgtgtcaccacacccggctaatttttttctatttttaatagagacgggggttcactgtgttagccaggatggtctccatctcctgacctcatgatccgccccccgtggcttcccaaagtgctgggtaagggctttttttaaaagtgatgtcaaggaaataactgtcatgaataaaagaaatgtcagacataaatactcttgatgccctatgattatttctgtggccatagggattaggtgctctgattagtgatttatataa

SEQ ID NO: 28763 - DNA, 206 bp, Homo sapiens
actacattatgtagaattttgtaggtcattatttgtactttggattttattctaagaagtttctggagagttttaaaacatggaagcaacaggacctcatttatgtatttaaaaaggtcactccagctgctgagggaagaatggagttacgggagggcaggagtagaaacagaagaccactcttccaggaaagccatgactggtac

SEQ ID NO: 28764 - DNA, 516 bp, Homo sapiens
gcatatacaaaaatgtatatgtgtttatggtggctgtatgataagattaaaagcgacttgtttgaagaaatttcaaaagttacaaaattggctggacatggtggctcatgcctcccagcactttgggaggctgaggcaggtggatcacttgaggccagagtttgagaccagcctggtcaacgtggtgaaaccctgtctctactaaaaatacaaaaattagccaggagtggtggtgcatgcctgtggtcccagctactggggactaaggcatgaaaatcacttgaatacgggatgctgaagctgcagtgagctgagattgtgccactgcacttcagtctgggtgatgaaaggagatatctcacaaaaattacaaaaataaaaaagttacaaaatgtccgcatttcatggattatcagcactttgcaccttatttaattgctaaataattctttaaaaatacctgatttctgtgtgagtgtttgtgtgtgtgtttttatcaaatttaaatggcactta

SEQ ID NO: 28765 - DNA, 477 bp, Homo sapiens
tggacatctgaaaaactaatcattttgagcagaacaatgcattaacaccccttctttttaatttgtatgggaatgacttgaagacttctctatgtgagatagaacaatgtctcccccatgcccagttttgagaatagaaaaacgacacttctttgtaatagctagtatggtagagtggtctcaaaagagtatttaatttgtgtaagattggatggttcaagacaaagctaaaaaataaaactgttacagggccttgggtatttaaatggcttatatttgccagaagctactggcttgaaaataagtattctctgagtggctttaatttctgtttttctctgtatggcctcagtggataaagagagacagttaccgagatctcagatagaacattgggcctgattgattaactttgctaagagctacagcagacattagactattttatgaaggaaaacttggccctcccagtggttt

SEQ ID NO: 28766 - DNA, 859 bp, Homo sapiens
ggggccgcagaaccagtctcctcctttcccctgctcagacaaagggcacgggaagggctttgctggggcaaaggggggtggggggttctctgtcccacgacagatgggtcgcggttaagactttaattgctgacttttgggccggatcagattccttttcctacctgccacttcccagcagcgaaaaatccccctcctgctgcactcctccgccaccgggctaggttgaaaggaaaaagccaagaagcgcgaagagcccggctctggaaggctttggagagtccagctgacttgtacacaattcgcggcctctggagccttacctgccttcttgactgaatgccaccagttcgttttacgcttgtggcctgaggtgtgtccctccagactgagaggctatgactcagggttggactttatggaaaaaaagaagtttataaaacaagtaacccagtttctccaacctttactgtggagcaacagcgtcaagcaacaaaacccagcaaagttttgcttgtcacttacaagggtgttactgaaatctggaaggcgaacaattagaagatagcccaaacatgctctattgctctacactgaaatacttgcctccaataatagaaaaaacctgttttcgtgcaattgattgattagcgttctgcagcagtccctggacaattttaaagacattttgtgtttgtggccaaaattagaaacaagcagacacacacacaaaacaaccatattcaagacacggttcgactgtttccttgacactacccacgaagtttaaagcattttttatgttattttcaaactttcttaagtgatcccatgaaataaaagtcgataatagaaatta

SEQ ID NO: 28767 - DNA, 723 bp, Homo sapiens
atgtccaaaccttcagaccacatcaagcggcccatgaacgccttcatggtatggtcccggggccagcggcgcaagatggcccaggaaaaccccaagatgcacaactcggagatcagcaaacgcctaggtgccgaatggaagcttctgtccgaggcagagaagcggccatacatcgatgaagccaagcggctacgcgcccagcacatgaaggagcaccctgactacaagtaccgacctcggcgcaagcccaagaacctgctcaagaaggacaggtatgtcttccccttgccctacctgggcgacacggacccgctcaaggcggctggcctgcccgtgggggcctccgacggcctcctgagcgcgcccgagaaagcccgggccttcttgccgccggcctcggcgccctactccctgctggaccccgcgcagtttagctcgagcgccatccagaagatgggcgaagtgccccacaccttggctaccggcgctctgccctacgcgtccaccctgggctaccagaacggcgccttcggcagcctcagctgccccagccagcacacgcacacgcacccgtcccccaccaaccctggctacgtggtgccctgtaactgtaccgcctggtctgcctccaccctgcagccccccgtcgcctacatcctcttcccaggcatgaccaagactggcatagacccttattcgtcagcccacgctacggccatgtaa

SEQ ID NO: 28768 - DNA, 1401 bp, Homo sapiens
atgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaa

SEQ ID NO: 28769 - DNA, 1400 bp, Homo sapiens
  misc_feature (1390)..(1390): n is a, c, g, or t
  misc_feature (1399)..(1399): n is a, c, g, or t
atgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgaccccgtgcctttctttganccttggaang

SEQ ID NO: 28770 - DNA, 417 bp, Homo sapiens
gaaaagtctcatacctattactttgtagtagttgttattactaaagtgttataatgtgtctgcaactatatttcatgtttatattagtcttgtgaaaagtaatccttctgtctgtttgtagacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcatttatta

SEQ ID NO: 28771 - DNA, 331 bp, Homo sapiens
ctcaacgcttgatacttcctcgaccaaagccttcaacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcatttatta

SEQ ID NO: 28772 - DNA, 450 bp, Homo sapiens
ctagaggactccttcgacggtgtctggaaagaggtgcaagaagactgcagagatgaatgaaaagctctccaagatgggcgaaagttcacttagaaactttacaatggatacagagtcaagtgtttataacttcgaaggagaagactatagagaaaaacaaaagattgcattcacagagtggattgaaccacctaaacgagaaagaaaagccaactatgccgttgatgcatatttcagggaagctcttcgtgttagtgaacctaaagcacccaaggctcctcgacctccaaaacaacccaatgttcaggatttccagttctttcctccacgtttatttgaattactggaaaaagaaattctgttttacagaaaaactattgggtacaaggtacctcgaaatcctgagctgcctaacgcagcacagaacaccgtcgaaggggtaccgagctc

SEQ ID NO: 28773 - DNA, 155 bp, Homo sapiens
tgtccaaacgctgatacccaaggctcctcgacctccaaaacaacccaatgttcaggatttccagttctttcctccacgtttatttgaattactggaaaaagaaattctgttttacagaaaaactattgggtacaaggcattggcaattatctgcc

SEQ ID NO: 28774 - DNA, 2666 bp, Homo sapiens
ggacgcgtgggtcgacccacgcgtccgtgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaagactgcagagatgaatgaaaagctctccaagatgggcgaaagttcacttagaaactttacaatggatacagagtcaagtgtttataacttcgaaggagaagactatagagaaaaacaaaagattgcattcacagagtggattgaaccacctaaacgagaaagaaaagccaactatgccgttgatgcatatttcagggaagctcttcgtgttagtgaacctaaagcacccaaggctcctcgacctccaaaacaacccaatgttcaggatttccagttctttcctccacgtttatttgaattactggaaaaagaaattctgttttacagaaaaactattgggtacaaggtacctcgaaatcctgagctgcctaacgcagcacaggcacaaaaagaagaacagcttaaaattgatgaagctgaatcccttaatgatgaagagttagaggaaaaagagaagcttctaacacagggatttaccaattggaataagagagattttaaccagtttatcaaagctaatgagaagtggggtcgtgatgatattgaaaatatagcaagagaagtagaaggcaaaactccagaagaagtcattgaatattcagctgtgttttgggaaaggtgcaacgagctccaggacatagagaagattatggctcagattgaaaggggagaggcgagaattcaaagaagaataagcatcaagaaagcacttgacacaaagattggacggtacaaagcaccttttcatcagctgagaatatcatatggtactaacaaaggaaaaaactatactgaagaagaagatcgttttctgatttgtatgcttcacaaacttggatttgacaaagaaaatgtttatgatgaattgcgacagtgtattcgcaactctcctcagttcagatttgactggtttcttaagtccagaactgcaatggagctccagaggagatgtaataccttaattactttgattgaaagagaaaacatggaactagaagaaaaggagaaggcagagaaaaagaaacgaggaccaaagccttcaacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcatttattactaagtgtttcatttgatttatttttctattgtagttccatttgtgaagattgtgactttttgtttattagctataatttctacacttgtaaggcttacaaacaagttaaaaagaaaattgcaaataacatttgtccctttcagtcttcacctagttgtgtaattattttaattcactttgcctttgcagaaatttgggtattttctttgtagtgctattgagtctcatctggaaagattatataaattgcattctccttgcttatgtgggtagaatgggagaagaaggcaagacaaagtatacttaaattctatgcatatttctgttatgctttctgttttttttagttgattctgaaatgaatatgccctattcttttgaaagaatggccttttagttgtatagccaaagacatttagtattttccggttccttaaggtattactgtaccattttgtaaaaggaatattattattattatttttaattatttggtaaatattttgtcatatgaccttctgaagcagccacaacttagataatgtcagaactaaggtgatttttttttttttaattttgaaagcccagccaaaatgaggtgtgaatttgtcatactgttacattgaaattggtaacaaaatatatcccctcccatttggacttttagggtaaatgaaaattttattgtattttaaagtagtttctaagtgttagcaagactgactataattccagtttctgttttctatggacagacctgataaactggagaccctaaagcaggaatacccaaattatagtgtcaggattttagctgtaccagaggcctttatgtgctacacataatttgtataaaattttatatgtgcagattgggtacataaacagttctccatttttctaagggaatgcaataaatgtagcatcgtgaataaatataacttttataatccgtaaa

SEQ ID NO: 28775 - DNA, 4684 bp, Homo sapiens
ctaacaacaaaaaaccgtgagacttcacttggggtaaccataacgtcgtcaaggctgtggcgtcacgcctctaagcggatacggcagaagttttggggccagacacaagacttccaagtttgaatgggcagcgcaaaacccagacaagttttccggtagtgccgccaacccctgtcaggcacagaagacacagcgagaaccgtgagccgttacgaaagcctaaaacactgagctcgcgtcctgccaagcagcaggcgcacaaacctacacctccgagcgctccctggaggtcccgcccactcttctctcccgagccggctagagatctggaagagggcgggccaagggtgaggagggcagtatgcgcatgcgcgctcaggacccagtcagtgagccaataaggaatctcgcgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcgccggtggaacctagagccccgcggaagagcagaacgtttgggagtgtgcagctcctgggcccggctcaggcccgtcgcggaggcgcggcgcaggggagcgctcgggtgggagtctcgctcctccaccagtttattgcgacgtagcatccaggcctaggcctccccgtccatccccgccggactcgggcctctggcagcagcgggtgacgcagacggaacatcatgtcgtccgcggccgagcctccgccacccccgcctcccgagagcgcgccttccaagcccgcagcctcgatcgccagcggcgggagcaacagcagcaacaaaggcggccccgaaggcgtcgcggcgcaggcggttgcgtctgcggccagcgctggtcccgcagacgccgagatggaggaaatatttgatgatgcgtcacctggaaagcaaaaggaaatccaagaaccagatcctacctatgaagaaaaaatgcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttactatccgttggcgattaccgacaccgtagaacagagcaagaggaggatgaagagctattaacagaaagctccaaagcaaccaatgtttgcactcgatttgaagactctccatcgtatgtaaaatggggtaaactgagagattatcaggtccgaggattaaactggctcatttctttgtatgagaatggcatcaatggtatccttgcagatgaaatgggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaagttgtcagaaatagtgagggaattcaagactacaaatagactattattaactggaacacctcttcagaacaacttgcatgagctgtggtcacttcttaactttctgttgccagatgtgtttaattcagcagatgactttgattcctggtttgatacaaacaactgccttggggatcaaaaactagttgagaggcttcatatggttttgcgtccattcctccttcgtcgaattaaggctgatgttgaaaagagtttgcctccaaagaaggaagtaaaaatctatgtgggcctcagcaaaatgcaaagggaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaagactgcagagatgaatgaaaagctctccaagatgggcgaaagttcacttagaaactttacaatggatacagagtcaagtgtttataacttcgaaggagaagactatagagaaaaacaaaagattgcattcacagagtggattgaaccacctaaacgagaaagaaaagccaactatgccgttgatgcatatttcagggaagctcttcgtgttagtgaacctaaagcacccaaggctcctcgacctccaaaacaacccaatgttcaggatttccagttctttcctccacgtttatttgaattactggaaaaagaaattctgttttacagaaaaactattgggtacaaggtacctcgaaatcctgagctgcctaacgcagcacaggcacaaaaagaagaacagcttaaaattgatgaagctgaatcccttaatgatgaagagttagaggaaaaagagaagcttctaacacagggatttaccaattggaataagagagattttaaccagtttatcaaagctaatgagaagtggggtcgtgatgatattgaaaatatagcaagagaagtagaaggcaaaactccagaagaagtcattgaatattcagctgtgttttgggaaaggtgcaacgagctccaggacatagagaagattatggctcagattgaaaggggagaggcgagaattcaaagaagaataagcatcaagaaagcacttgacacaaagattggacggtacaaagcaccttttcatcagctgagaatatcatatggtactaacaaaggaaaaaactatactgaagaagaagatcgttttctgatttgtatgcttcacaaacttggatttgacaaagaaaatgtttatgatgaattgcgacagtgtattcgcaactctcctcagttcagatttgactggtttcttaagtccagaactgcaatggagctccagaggagatgtaataccttaattactttgattgaaagagaaaacatggaactagaagaaaaggagaaggcagagaaaaagaaacgaggaccaaagccttcaacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcatttattaaaaaaaaaaaaaaaaaaaaaaaaaaaaaaaaaaaaaaaaaaaaaaaaaaaaaaaaaaaaaaaaaaaagagaacgagcaaaacaaaaaaaaaaaaaaaaaaaagaaaagaaaaaaaaaaaaaaaaaaaaaacacagagaaaggagaaaaaaaaaaaaaaaaaaataaataaaaagacgaacatgggagacagagagaaacgaaaagaaaagaaaatcgacaagaagagaaaaaggaggagcagcagaacaccgagagagagagacaaaaagaagaaaacaagacagaaaaaaaaagaacaggataaagaaagcgacaagtaaatgagtagaataaagaagcaaaaagaggatggaaggaagaaggaaaaagagataaaataaggaataatgacaacaatcttaagaaaaaagaggtgaaagtaac

SEQ ID NO: 28776 - DNA, 3216 bp, Homo sapiens
ctaacaacaaaaaaccgtgagacttcacttggggtaaccataacgtcgtcaaggctgtggcgtcacgcctctaagcggatacggcagaagttttggggccagacacaagacttccaagtttgaatgggcagcgcaaaacccagacaagttttccggtagtgccgccaacccctgtcaggcacagaagacacagcgagaaccgtgagccgttacgaaagcctaaaacactgagctcgcgtcctgccaagcagcaggcgcacaaacctacacctccgagcgctccctggaggtcccgcccactcttctctcccgagccggctagagatctggaagagggcgggccaagggtgaggagggcagtatgcgcatgcgcgctcaggacccagtcagtgagccaataaggaatctcgcgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcgccggtggaacctagagccccgcggaagagcagaacgtttgggagtgtgcagctcctgggcccggctcaggcccgtcgcggaggcgcggcgcaggggagcgctcgggtgggagtctcgctcctccaccagtttattgcgacgtagcatccaggcctaggcctccccgtccatccccgccggactcgggcctctggcagcagcgggtgacgcagacggaacatcatgtcgtccgcggccgagcctccgccacccccgcctcccgagagcgcgccttccaagcccgcagcctcgatcgccagcggcgggagcaacagcagcaacaaaggcggccccgaaggcgtcgcggcgcaggcggttgcgtctgcggccagcgctggtcccgcagacgccgagatggaggaaatatttgatgatgcgtcacctggaaagcaaaaggaaatccaagaaccagatcctacctatgaagaaaaaatgcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttactatccgttggcgattaccgacaccgtagaacagagcaagaggaggatgaagagctattaacagaaagctccaaagcaaccaatgtttgcactcgatttgaagactctccatcgtatgtaaaatggggtaaactgagagattatcaggtccgaggattaaactggctcatttctttgtatgagaatggcatcaatggtatccttgcagatgaaatgggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaagttgtcagaaatagtgagggaattcaagactacaaatagactattattaactggaacacctcttcagaacaacttgcatgagctgtggtcacttcttaactttctgttgccagatgtgtttaattcagcagatgactttgattcctggtttgatacaaacaactgccttggggatcaaaaactagttgagaggcttcatatggttttgcgtccattcctccttcgtcgaattaaggctgatgttgaaaagagtttgcctccaaagaaggaagtaaaaatctatgtgggcctcagcaaaatgcaaagggaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaagactgcagagatgaatgaaaagctctccaagatgggcgaaagttcacttagaaactttacaatggatacagagtcaagtgtttataacttcgaaggagaagactatagagaaaaacaaaagattgcattcacagagtggattgaaccacctaaacgagaaagaaaagccaactatgccgttgatgcatatttcagggaagctcttcgtgttagtgaacctaaagcacccaaggttctctacttcaaaacaaaacggtgagggtttcaggtttttcttcccgttatttgttctgg

SEQ ID NO: 28777 - DNA, 2946 bp, Homo sapiens
ctaacaacaaaaaaccgtgagacttcacttggggtaaccataacgtcgtcaaggctgtggcgtcacgcctctaagcggatacggcagaagttttggggccagacacaagacttccaagtttgaatgggcagcgcaaaacccagacaagttttccggtagtgccgccaacccctgtcaggcacagaagacacagcgagaaccgtgagccgttacgaaagcctaaaacactgagctcgcgtcctgccaagcagcaggcgcacaaacctacacctccgagcgctccctggaggtcccgcccactcttctctcccgagccggctagagatctggaagagggcgggccaagggtgaggagggcagtatgcgcatgcgcgctcaggacccagtcagtgagccaataaggaatctcgcgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcgccggtggaacctagagccccgcggaagagcagaacgtttgggagtgtgcagctcctgggcccggctcaggcccgtcgcggaggcgcggcgcaggggagcgctcgggtgggagtctcgctcctccaccagtttattgcgacgtagcatccaggcctaggcctccccgtccatccccgccggactcgggcctctggcagcagcgggtgacgcagacggaacatcatgtcgtccgcggccgagcctccgccacccccgcctcccgagagcgcgccttccaagcccgcagcctcgatcgccagcggcgggagcaacagcagcaacaaaggcggccccgaaggcgtcgcggcgcaggcggttgcgtctgcggccagcgctggtcccgcagacgccgagatggaggaaatatttgatgatgcgtcacctggaaagcaaaaggaaatccaagaaccagatcctacctatgaagaaaaaatgcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttactatccgttggcgattaccgacaccgtagaacagagcaagaggaggatgaagagctattaacagaaagctccaaagcaaccaatgtttgcactcgatttgaagactctccatcgtatgtaaaatggggtaaactgagagattatcaggtccgaggattaaactggctcatttctttgtatgagaatggcatcaatggtatccttgcagatgaaatgggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaagttgtcagaaatagtgagggaattcaagactacaaatagactattattaactggaacacctcttcagaacaacttgcatgagctgtggtcacttcttaactttctgttgccagatgtgtttaattcagcagatgactttgattcctggtttgatacaaacaactgccttggggatcaaaaactagttgagaggcttcatatggttttgcgtccattcctccttcgtcgaattaaggctgatgttgaaaagagtttgcctccaaagaaggaagtaaaaatctatgtgggcctcagcaaaatgcaaagggaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaaggtgagatgtagattaaataatgc

SEQ ID NO: 28778 - DNA, 373 bp, Homo sapiens
cgacaccgtagaacagagcaagaggaggatgaagagctattaacagaaagctccaaagcaaccaatgtttgcactcgatttgaagactctccatcgtgtatgttaaacacacttgatttttttaaaaaattgccctttgagatctcctttggttaatgttttggatttgtgttggctactatttgtgaagcaaatttttagtagtcttagatgtttattggttatgaaataaacttcagattttgatggagatgagagcatattacaggatagtagtgctgtatttcaaagttatataaaatgtcattgtgtttgttattgccctgaagtatatgtaaatctaaggatcgttttgctttatatttgtcccaca

SEQ ID NO: 28779 - DNA, 542 bp, Homo sapiens
taaagcaggaatacccaaattatagtgtcaggattttagctgtaccagaggcctttatgtgctacacataatttgtataaaattttatatgtgcagattgggtacataaacagttctccatttttctaagggaatgcaataaatgtagcatcgtgaataaatataacttttataatccgtaaagtggtcttttctttccatttcttttattgtttctcaacctcattcacttttccttaggacacattcccttaatggatatctttcccttaaatttctattagtagttgttttcatctgcccacatgtaattgaagatttaaaaaaaaaattctgatacctgcagtattactaatactgcttaatttcttgaaatgtggaattgctgctgttaatgtcaagcaaaacgcagtatttatggcaaattgtaaagtaatttgaatttagtgctacctcaaaattaactttttaaatactatgttagattcttaacagttaaaggtctaatacatgcatgaggaatggttacttatgaaaggaaa

SEQ ID NO: 28780 - DNA, 4260 bp, Homo sapiens
ctaacaacaaaaaaccgtgagacttcacttggggtaaccataacgtcgtcaaggctgtggcgtcacgcctctaagcggatacggcagaagttttggggccagacacaagacttccaagtttgaatgggcagcgcaaaacccagacaagttttccggtagtgccgccaacccctgtcaggcacagaagacacagcgagaaccgtgagccgttacgaaagcctaaaacactgagctcgcgtcctgccaagcagcaggcgcacaaacctacacctccgagcgctccctggaggtcccgcccactcttctctcccgagccggctagagatctggaagagggcgggccaagggtgaggagggcagtatgcgcatgcgcgctcaggacccagtcagtgagccaataaggaatctcgcgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcgccggtggaacctagagccccgcggaagagcagaacgtttgggagtgtgcagctcctgggcccggctcaggcccgtcgcggaggcgcggcgcaggggagcgctcgggtgggagtctcgctcctccaccagtttattgcgacgtagcatccaggcctaggcctccccgtccatccccgccggactcgggcctctggcagcagcgggtgacgcagacggaacatcatgtcgtccgcggccgagcctccgccacccccgcctcccgagagcgcgccttccaagcccgcagcctcgatcgccagcggcgggagcaacagcagcaacaaaggcggccccgaaggcgtcgcggcgcaggcggttgcgtctgcggccagcgctggtcccgcagacgccgagatggaggaaatatttgatgatgcgtcacctggaaagcaaaaggaaatccaagaaccagatcctacctatgaagaaaaaatgcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttactatccgttggcgattaccgacaccgtagaacagagcaagaggaggatgaagagctattaacagaaagctccaaagcaaccaatgtttgcactcgatttgaagactctccatcgtatgtaaaatggggtaaactgagagattatcaggtccgaggattaaactggctcatttctttgtatgagaatggcatcaatggtatccttgcagatgaaatgggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaagttgtcagaaatagtgagggaattcaagactacaaatagactattattaactggaacacctcttcagaacaacttgcatgagctgtggtcacttcttaactttctgttgccagatgtgtttaattcagcagatgactttgattcctggtttgatacaaacaactgccttggggatcaaaaactagttgagaggcttcatatggttttgcgtccattcctccttcgtcgaattaaggctgatgttgaaaagagtttgcctccaaagaaggaagtaaaaatctatgtgggcctcagcaaaatgcaaagggaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaagactgcagagatgaatgaaaagctctccaagatgggcgaaagttcacttagaaactttacaatggatacagagtcaagtgtttataacttcgaaggagaagactatagagaaaaacaaaagattgcattcacagagtggattgaaccacctaaacgagaaagaaaagccaactatgccgttgatgcatatttcagggaagctcttcgtgttagtgaacctaaagcacccaaggctcctcgacctccaaaacaacccaatgttcaggatttccagttctttcctccacgtttatttgaattactggaaaaagaaattctgttttacagaaaaactattgggtacaaggtacctcgaaatcctgagctgcctaacgcagcacaggcacaaaaagaagaacagcttaaaattgatgaagctgaatcccttaatgatgaagagttagaggaaaaagagaagcttctaacacagggatttaccaattggaataagagagattttaaccagtttatcaaagctaatgagaagtggggtcgtgatgatattgaaaatatagcaagagaagtagaaggcaaaactccagaagaagtcattgaatattcagctgtgttttgggaaaggtgcaacgagctccaggacatagagaagattatggctcagattgaaaggggagaggcgagaattcaaagaagaataagcatcaagaaagcacttgacacaaagattggacggtacaaagcaccttttcatcagctgagaatatcatatggtactaacaaaggaaaaaactatactgaagaagaagatcgttttctgatttgtatgcttcacaaacttggatttgacaaagaaaatgtttatgatgaattgcgacagtgtattcgcaactctcctcagttcagatttgactggtttcttaagtccagaactgcaatggagctccagaggagatgtaataccttaattactttgattgaaagagaaaacatggaactagaagaaaaggagaaggcagagaaaaagaaacgaggaccaaagccttcaacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcatttatta

SEQ ID NO: 28781 - DNA, 5219 bp, Homo sapiens
ctaacaacaaaaaaccgtgagacttcacttggggtaaccataacgtcgtcaaggctgtggcgtcacgcctctaagcggatacggcagaagttttggggccagacacaagacttccaagtttgaatgggcagcgcaaaacccagacaagttttccggtagtgccgccaacccctgtcaggcacagaagacacagcgagaaccgtgagccgttacgaaagcctaaaacactgagctcgcgtcctgccaagcagcaggcgcacaaacctacacctccgagcgctccctggaggtcccgcccactcttctctcccgagccggctagagatctggaagagggcgggccaagggtgaggagggcagtatgcgcatgcgcgctcaggacccagtcagtgagccaataaggaatctcgcgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcgccggtggaacctagagccccgcggaagagcagaacgtttgggagtgtgcagctcctgggcccggctcaggcccgtcgcggaggcgcggcgcaggggagcgctcgggtgggagtctcgctcctccaccagtttattgcgacgtagcatccaggcctaggcctccccgtccatccccgccggactcgggcctctggcagcagcgggtgacgcagacggaacatcatgtcgtccgcggccgagcctccgccacccccgcctcccgagagcgcgccttccaagcccgcagcctcgatcgccagcggcgggagcaacagcagcaacaaaggcggccccgaaggcgtcgcggcgcaggcggttgcgtctgcggccagcgctggtcccgcagacgccgagatggaggaaatatttgatgatgcgtcacctggaaagcaaaaggaaatccaagaaccagatcctacctatgaagaaaaaatgcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttactatccgttggcgattaccgacaccgtagaacagagcaagaggaggatgaagagctattaacagaaagctccaaagcaaccaatgtttgcactcgatttgaagactctccatcgtatgtaaaatggggtaaactgagagattatcaggtccgaggattaaactggctcatttctttgtatgagaatggcatcaatggtatccttgcagatgaaatgggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaagttgtcagaaatagtgagggaattcaagactacaaatagactattattaactggaacacctcttcagaacaacttgcatgagctgtggtcacttcttaactttctgttgccagatgtgtttaattcagcagatgactttgattcctggtttgatacaaacaactgccttggggatcaaaaactagttgagaggcttcatatggttttgcgtccattcctccttcgtcgaattaaggctgatgttgaaaagagtttgcctccaaagaaggaagtaaaaatctatgtgggcctcagcaaaatgcaaagggaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaagactgcagagatgaatgaaaagctctccaagatgggcgaaagttcacttagaaactttacaatggatacagagtcaagtgtttataacttcgaaggagaagactatagagaaaaacaaaagattgcattcacagagtggattgaaccacctaaacgagaaagaaaagccaactatgccgttgatgcatatttcagggaagctcttcgtgttagtgaacctaaagcacccaaggctcctcgacctccaaaacaacccaatgttcaggatttccagttctttcctccacgtttatttgaattactggaaaaagaaattctgttttacagaaaaactattgggtacaaggtacctcgaaatcctgagctgcctaacgcagcacaggcacaaaaagaagaacagcttaaaattgatgaagctgaatcccttaatgatgaagagttagaggaaaaagagaagcttctaacacagggatttaccaattggaataagagagattttaaccagtttatcaaagctaatgagaagtggggtcgtgatgatattgaaaatatagcaagagaagtagaaggcaaaactccagaagaagtcattgaatattcagctgtgttttgggaaaggtgcaacgagctccaggacatagagaagattatggctcagattgaaaggggagaggcgagaattcaaagaagaataagcatcaagaaagcacttgacacaaagattggacggtacaaagcaccttttcatcagctgagaatatcatatggtactaacaaaggaaaaaactatactgaagaagaagatcgttttctgatttgtatgcttcacaaacttggatttgacaaagaaaatgtttatgatgaattgcgacagtgtattcgcaactctcctcagttcagatttgactggtttcttaagtccagaactgcaatggagctccagaggagatgtaataccttaattactttgattgaaagagaaaacatggaactagaagaaaaggagaaggcagagaaaaagaaacgaggaccaaagccttcaacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcatttattactaagtgtttcatttgatttatttttctattgtagttccatttgtgaagattgtgactttttgtttattagctataatttctacacttgtaaggcttacaaacaagttaaaaagaaaattgcaaataacatttgtccctttcagtcttcacctagttgtgtaattattttaattcactttgcctttgcagaaatttgggtattttctttgtagtgctattgagtctcatctggaaagattatataaattgcattctccttgcttatgtgggtagaatgggagaagaaggcaagacaaagtatacttaaattctatgcatatttctgttatgctttctgttttttttagttgattctgaaatgaatatgccctattcttttgaaagaatggccttttagttgtatagccaaagacatttagtattttccggttccttaaggtattactgtaccattttgtaaaaggaatattattattattatttttaattatttggtaaatattttgtcatatgaccttctgaagcagccacaacttagataatgtcagaactaaggtgatttttttttttttaattttgaaagcccagccaaaatgaggtgtgaatttgtcatactgttacattgaaattggtaacaaaatatatcccctcccatttggacttttagggtaaatgaaaattttattgtattttaaagtagtttctaagtgttagcaagactgactataattccagtttctgttttctatggacagacctgataaactggagaccctaaagcaggaatacccaaattatagtgtcaggattttagctgtaccagaggcctttatgtgctacacataatttgtataaaattttatatgtgcagattgggtacataaacagttctccatttttctaagggaatgcaataaatgtagcatcgtgaataaatataacttttataatccgtaaa

SEQ ID NO: 28782 - DNA, 5250 bp, Homo sapiens
ctaacaacaaaaaaccgtgagacttcacttggggtaaccataacgtcgtcaaggctgtggcgtcacgcctctaagcggatacggcagaagttttggggccagacacaagacttccaagtttgaatgggcagcgcaaaacccagacaagttttccggtagtgccgccaacccctgtcaggcacagaagacacagcgagaaccgtgagccgttacgaaagcctaaaacactgagctcgcgtcctgccaagcagcaggcgcacaaacctacacctccgagcgctccctggaggtcccgcccactcttctctcccgagccggctagagatctggaagagggcgggccaagggtgaggagggcagtatgcgcatgcgcgctcaggacccagtcagtgagccaataaggaatctcgcgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcgccggtggaacctagagccccgcggaagagcagaacgtttgggagtgtgcagctcctgggcccggctcaggcccgtcgcggaggcgcggcgcaggggagcgctcgggtgggagtctcgctcctccaccagtttattgcgacgtagcatccaggcctaggcctccccgtccatccccgccggactcgggcctctggcagcagcgggtgacgcagacggaacatcatgtcgtccgcggccgagcctccgccacccccgcctcccgagagcgcgccttccaagcccgcagcctcgatcgccagcggcgggagcaacagcagcaacaaaggcggccccgaaggcgtcgcggcgcaggcggttgcgtctgcggccagcgctggtcccgcagacgccgagatggaggaaatatttgatgatgcgtcacctggaaagcaaaaggaaatccaagaaccagatcctacctatgaagaaaaaatgcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttactatccgttggcgattaccgacaccgtagaacagagcaagaggaggatgaagagctattaacagaaagctccaaagcaaccaatgtttgcactcgatttgaagactctccatcgtatgtaaaatggggtaaactgagagattatcaggtccgaggattaaactggctcatttctttgtatgagaatggcatcaatggtatccttgcagatgaaatgggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaagttgtcagaaatagtgagggaattcaagactacaaatagactattattaactggaacacctcttcagaacaacttgcatgagctgtggtcacttcttaactttctgttgccagatgtgtttaattcagcagatgactttgattcctggtttgatacaaacaactgccttggggatcaaaaactagttgagaggcttcatatggttttgcgtccattcctccttcgtcgaattaaggctgatgttgaaaagagtttgcctccaaagaaggaagtaaaaatctatgtgggcctcagcaaaatgcaaagggaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaagactgcagagatgaatgaaaagctctccaagatgggcgaaagttcacttagaaactttacaatggatacagagtcaagtgtttataacttcgaaggagaagactatagagaaaaacaaaagattgcattcacagagtggattgaaccacctaaacgagaaagaaaagccaactatgccgttgatgcatatttcagggaagctcttcgtgttagtgaacctaaagcacccaaggctcctcgacctccaaaacaacccaatgttcaggatttccagttctttcctccacgtttatttgaattactggaaaaagaaattctgttttacagaaaaactattgggtacaaggtacctcgaaatcctgagctgcctaacgcagcacaggcacaaaaagaagaacagcttaaaattgatgaagctgaatcccttaatgatgaagagttagaggaaaaagagaagcttctaacacagggatttaccaattggaataagagagattttaaccagtttatcaaagctaatgagaagtggggtcgtgatgatattgaaaatatagcaagagaagtagaaggcaaaactccagaagaagtcattgaatattcagctgtgttttgggaaaggtgcaacgagctccaggacatagagaagattatggctcagattgaaaggggagaggcgagaattcaaagaagaataagcatcaagaaagcacttgacacaaagattggacggtacaaagcaccttttcatcagctgagaatatcatatggtactaacaaaggaaaaaactatactgaagaagaagatcgttttctgatttgtatgcttcacaaacttggatttgacaaagaaaatgtttatgatgaattgcgacagtgtattcgcaactctcctcagttcagatttgactggtttcttaagtccagaactgcaatggagctccagaggagatgtaataccttaattactttgattgaaagagaaaacatggaactagaagaaaaggagaaggcagagaaaaagaaacgaggaccaaagccttcaacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcatttattactaagtgtttcatttgatttatttttctattgtagttccatttgtgaagattgtgactttttgtttattagctataatttctacacttgtaaggcttacaaacaagttaaaaagaaaattgcaaataacatttgtccctttcagtcttcacctagttgtgtaattattttaattcactttgcctttgcagaaatttgggtattttctttgtagtgctattgagtctcatctggaaagattatataaattgcattctccttgcttatgtgggtagaatgggagaagaaggcaagacaaagtatacttaaattctatgcatatttctgttatgctttctgttttttttagttgattctgaaatgaatatgccctattcttttgaaagaatggccttttagttgtatagccaaagacatttagtattttccggttccttaaggtattactgtaccattttgtaaaaggaatattattattattatttttaattatttggtaaatattttgtcatatgaccttctgaagcagccacaacttagataatgtcagaactaaggtgatttttttttttttaattttgaaagcccagccaaaatgaggtgtgaatttgtcatactgttacattgaaattggtaacaaaatatatcccctcccatttggacttttagggtaaatgaaaattttattgtattttaaagtagtttctaagtgttagcaagactgactataattccagtttctgttttctatggacagacctgataaactggagaccctaaagcaggaatacccaaattatagtgtcaggattttagctgtaccagaggcctttatgtgctacacataatttgtataaaattttatatgtgcagattgggtacataaacagttctccatttttctaagggaatgcaataaatgtagcatcgtgaataaatataacttttataatccgtaaaaaaaaaacaggatgaagaaaaaaaaccttgt

SEQ ID NO: 28783 - DNA, 3665 bp, Homo sapiens
  misc_feature (3610)..(3610): n is a, c, g, or t
ctaacaacaaaaaaccgtgagacttcacttggggtaaccataacgtcgtcaaggctgtggcgtcacgcctctaagcggatacggcagaagttttggggccagacacaagacttccaagtttgaatgggcagcgcaaaacccagacaagttttccggtagtgccgccaacccctgtcaggcacagaagacacagcgagaaccgtgagccgttacgaaagcctaaaacactgagctcgcgtcctgccaagcagcaggcgcacaaacctacacctccgagcgctccctggaggtcccgcccactcttctctcccgagccggctagagatctggaagagggcgggccaagggtgaggagggcagtatgcgcatgcgcgctcaggacccagtcagtgagccaataaggaatctcgcgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcgccggtggaacctagagccccgcggaagagcagaacgtttgggagtgtgcagctcctgggcccggctcaggcccgtcgcggaggcgcggcgcaggggagcgctcgggtgggagtctcgctcctccaccagtttattgcgacgtagcatccaggcctaggcctccccgtccatccccgccggactcgggcctctggcagcagcgggtgacgcagacggaacatcatgtcgtccgcggccgagcctccgccacccccgcctcccgagagcgcgccttccaagcccgcagcctcgatcgccagcggcgggagcaacagcagcaacaaaggcggccccgaaggcgtcgcggcgcaggcggttgcgtctgcggccagcgctggtcccgcagacgccgagatggaggaaatatttgatgatgcgtcacctggaaagcaaaaggaaatccaagaaccagatcctacctatgaagaaaaaatgcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttactatccgttggcgattaccgacaccgtagaacagagcaagaggaggatgaagagctattaacagaaagctccaaagcaaccaatgtttgcactcgatttgaagactctccatcgtatgtaaaatggggtaaactgagagattatcaggtccgaggattaaactggctcatttctttgtatgagaatggcatcaatggtatccttgcagatgaaatgggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaagttgtcagaaatagtgagggaattcaagactacaaatagactattattaactggaacacctcttcagaacaacttgcatgagctgtggtcacttcttaactttctgttgccagatgtgtttaattcagcagatgactttgattcctggtttgatacaaacaactgccttggggatcaaaaactagttgagaggcttcatatggttttgcgtccattcctccttcgtcgaattaaggctgatgttgaaaagagtttgcctccaaagaaggaagtaaaaatctatgtgggcctcagcaaaatgcaaagggaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaagactgcagagatgaatgaaaagctctccaagatgggcgaaagttcacttagaaactttacaatggatacagagtcaagtgtttataacttcgaaggagaagactatagagaaaaacaaaagattgcattcacagagtggattgaaccacctaaacgagaaagaaaagccaactatgccgttgatgcatatttcagggaagctcttcgtgttagtgaacctaaagcacccaaggctcctcgacctccaaaacaacccaatgttcaggatttccagttctttcctccacgtttatttgaattactggaaaaagaaattctgttttacagaaaaactattgggtacaaggtacctcgaaatcctgagctgcctaacgcagcacaggcacaaaaagaagaacagcttaaaattgatgaagctgaatcccttaatgatgaagagttagaggaaaaagagaagcttctaacacagggatttaccaattggaataagagagattttaaccagtttatcaaagctaatgagaagtggggtcgtgatgatattgaaaatatagcaagagaagtagaaggcaaaactccagaagaagtcattgaatattcagctgtgttttgggaaaggtgcaacgagctccaggacatagagaagattatggctcagattgaaaggggagaggcgaggagaggtggnaggagaggaagaggtgggaggagaggaagaggtgggaggagaggaagggtaccga

SEQ ID NO: 28784 - DNA, 3427 bp, Homo sapiens
ctaacaacaaaaaaccgtgagacttcacttggggtaaccataacgtcgtcaaggctgtggcgtcacgcctctaagcggatacggcagaagttttggggccagacacaagacttccaagtttgaatgggcagcgcaaaacccagacaagttttccggtagtgccgccaacccctgtcaggcacagaagacacagcgagaaccgtgagccgttacgaaagcctaaaacactgagctcgcgtcctgccaagcagcaggcgcacaaacctacacctccgagcgctccctggaggtcccgcccactcttctctcccgagccggctagagatctggaagagggcgggccaagggtgaggagggcagtatgcgcatgcgcgctcaggacccagtcagtgagccaataaggaatctcgcgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcgccggtggaacctagagccccgcggaagagcagaacgtttgggagtgtgcagctcctgggcccggctcaggcccgtcgcggaggcgcggcgcaggggagcgctcgggtgggagtctcgctcctccaccagtttattgcgacgtagcatccaggcctaggcctccccgtccatccccgccggactcgggcctctggcagcagcgggtgacgcagacggaacatcatgtcgtccgcggccgagcctccgccacccccgcctcccgagagcgcgccttccaagcccgcagcctcgatcgccagcggcgggagcaacagcagcaacaaaggcggccccgaaggcgtcgcggcgcaggcggttgcgtctgcggccagcgctggtcccgcagacgccgagatggaggaaatatttgatgatgcgtcacctggaaagcaaaaggaaatccaagaaccagatcctacctatgaagaaaaaatgcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttactatccgttggcgattaccgacaccgtagaacagagcaagaggaggatgaagagctattaacagaaagctccaaagcaaccaatgtttgcactcgatttgaagactctccatcgtatgtaaaatggggtaaactgagagattatcaggtccgaggattaaactggctcatttctttgtatgagaatggcatcaatggtatccttgcagatgaaatgggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaagttgtcagaaatagtgagggaattcaagactacaaatagactattattaactggaacacctcttcagaacaacttgcatgagctgtggtcacttcttaactttctgttgccagatgtgtttaattcagcagatgactttgattcctggtttgatacaaacaactgccttggggatcaaaaactagttgagaggcttcatatggttttgcgtccattcctccttcgtcgaattaaggctgatgttgaaaagagtttgcctccaaagaaggaagtaaaaatctatgtgggcctcagcaaaatgcaaagggaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaagactgcagagatgaatgaaaagctctccaagatgggcgaaagttcacttagaaactttacaatggatacagagtcaagtgtttataacttcgaaggagaagactatagagaaaaacaaaaggtaatttagaaataggtttgggttacatgaaagctttattttactggaaacttggaattttaagtgttactgtaatgtcttataattttgcttaaaacagtagtcatttttgcttattcacatctgaatattttcatcattatgtaaaatttaatgccagtttttcagttggtaagctctgaaatatttttaaagtttttgtaatgaagtttgtggtatatgtttacagtgaaatatattcttgtatgggatgaatagtaatttgggatggtaacctgattcattttattttaaacagcagaattggctggtaataaagggaaaaatttcttaacttcataagtaatacttggtaatatagagataaattgaaaaatacccaga

SEQ ID NO: 28785 - DNA, 1649 bp, Homo sapiens
ggcggcgccagcggacaccggagcgggcaggagcagcggccgcggcgccgcagggaccagcgggcccaggctcggtctggggttcttgcagctggcaccagccctcccggccccggccgcccacccgccgcggggaagatgccggaacagagtaacgattaccgcgtggtggtgttcggggcgggcggcgtgggcaagagctcgctggtgctgcgcttcgtgaagggcacgttccgcgacacctacatccccaccatcgaggacacctaccggcaggtgatcagctgcgacaagagcgtgtgcacgctgcagatcacagacaccaccggcagccaccagttcccggccatgcagcgcctgtccatctccaagggccacgccttcatcctggtgttctccgtcaccagcaagcagtcgctggaggagctggggcccatctacaagctcatcgtgcagatcaagggcagcgtggaggacatccccgtgatgctcgtgggcaacaagtgcgatgagacgcagcgggaggtggacacgcgcgaggcgcaggcggtggcccaggagtggaagtgcgctttcatggagacctcggccaagatgaactacaacgtcaaggagctcttccaggagctgctgacgctggagacgcgccggaacatgagcctcaacatcgacggcaagcgctccgggaagcagaagaggacagaccgcgtcaagggcaaatgcaccctcatgtgagcccggaacgcccgccggcgcggcggggagagaaaggtaggggagatgacgcgttggacacggagacacgaagaggagccagaaggatacgagaggatgacaggtgacgaggtgagcagaaaaacagaacagaacgacacacagcgccaacccaagagaaagaaaaacaggaccagaagaccagcacacgaaatcacgcagagagacaaagaaggacaacaagaagcaaaagcgacagcagaaccatcccgagacacaagaccaaccacaaaacacccccaccaagcgatgcgcaggagacccagccaaacacaaaacaccaaagacgagcaaagaagcacctaaagaagagaaaaacgacaatcgaaaatagaaagcgcgaggaagcaaacgacaggaccacaaatgaccaaacaaaaggcgaccagaaggacaagaaaagagacagagaaaagcccaccgcccacacaaagaacgacaccaccgggaagagacatcaagccagaggacagcaacacccaacagaagagcgaacacaagaaccagaggaagacaaaaggggcgcacgagcccaagagcaaagaaagagcaggagaaggcaagacgaacagaagaaaaggaccagaagcgaggaacgaaagcacgagacagaaacacacgaaacagacccgcagagaaagaaaaagaaacagaagcgagcaaaaccagacgagcaacaaaaccccaacgacacgcgcgaacaaccaagagagggaaggaagcacgacagagcagagaccgcccagacagagaacagaaaaagacgcgaacgaaaaaggcaaacagccacagcaaaacagacaagcaaagaaacacagggcaacgcgacccaacacagcagcaccgacgaacaagcagacaacaaaaacaaaaaa

SEQ ID NO: 28786 - DNA, 943 bp, Homo sapiens
agcttctgtttcctcatgttgttcctactttttaaataataaatggctctcagcatcttaggaactagatgggtcccatctgggtagaacctgctataatttttagaatcactcttgtaattcttacctcacttaaaatattaggaaacacagtaatagaaaagacagggagaactcgtctgcaggttttggcagtgaaatttgtcttccagtgaattgctattattttcaaattgcctatagtcaaaaagcttttccattgatggagacttactttcaaatgagcttgtgttgaattcagcactctagattctctctgacattttcctgtcttttgggaaaaaaaagcagatattccaaaaatggcagaaatctaatttttgtaaactttttcatctataggattgagccaaaaaacatacatactattttaaagaaaggtaccatctaattcttttattaaagatagctacttctgaaatgtcttaacagagtttcaagattgcaaagtagtattgcatagctggttttcttacatgtgatgatggaggagagaggaagacccagacttaggcatgtagtgaaatatgtacagtttctggcatcagtgtactatttatagtctatagcatacattacttgcaaatgggaaaagtattttataattatttttgtacctcaaaataattattatattctactgtattatattcaaattaaagtttattatttgattcttagtatgatattctgttgagtgtgatgagggtgggacctaagtatgtcatgtgccttctaccctttctttcctagccctagaatgaaaggagaagttggggccatagtatctttgaagggagttatttccaaaagctttactaaaggggggtcggggacacaaagggggttggggataaagccaaattgagggggggtccaaagg

SEQ ID NO: 28787 - DNA, 442 bp, Homo sapiens
gaaattggcaccaggcaggtgacactagaggccacggtcttaatgaccacacaacatggtcttcatcagaatagattccatctccatgatgctttgcactaattaattctttccgcagcagcaccatgaggttggcggttcctttatttgccagctgtttattatttctgtgctaccaacattatgccaggcatggattggagtgtggaatcattcctggaagccaggccatgttcctgagttgtgctgctgtaagaattgggatttaaagttccaaatgtgtggcttccagtattttccttctaaaacagacacacgtcttatcccatttttatggttacatcacaagaatgattcacatttaatcaaacaagtcaggcagaatgatagctaatctatctcagggtttgttgcaaatgttatttacacatattgtgatata

SEQ ID NO: 28788 - DNA, 684 bp, Homo sapiens
gcctgattgacccagctgttccacatgcaactcaccgattaatcatcctgatgtatgtctgagtgcccccaaccttcagctgtctgtgtccactggctctggcttgaaactcttccttaaccactcctacttttgcagatgtcttattgtacatctggcttagactatggcttccttcagttactgcctccctgccccaccattcaattccccacccccataaatataatctcgtctgattctaggagattgctgatagtctttccttattatctcatgcatttatgatttatatttgttaactgtaaatgtcatttcctcaggaaagttttttcctagccacccaatttaaagtaatttctcactttctatcacatcacctcagtttattttcattgtagcattcatctctatttaatatttatggtcttttgtctttccagacctaaatgcatactcctttaggagccttatatgatctatttacagctatatcataagtggttagaacagtgcctgatatataatagacattcagtatatgatagttgaattaagtgactttatcttttttaaaaacattatatgtcacatttgcttgaattacataaattttagattttataccagaaaccaggcttatcaaatattccatcttaacatctctgtcaagacaaaaaaaaa

SEQ ID NO: 28789 - DNA, 390 bp, Homo sapiens
gctgaaaatgagagtgagccacctttttgtgacctttggtcccactgggtgtcctgagacatccttcagcaatctgttgtctacattgagatgaaacttcccttcactttcaccatccagacaagtttttcactagctcctctgtattcagaaagactattaggcagatcacgaggtcaggagatcaagaccaccatggctaacatggtgaaaccccgtctctactaagtatacaaaaaattagccaggcatggtggcgggcgcctgtagtcccagctacccaggaggctgacgcaggagaatggtgtgaacccgggaggcggagcttgcagtgagccgagatcatgccacggcactccagcctggacgaaagagcgagactctgtctca

SEQ ID NO: 28790 - DNA, 503 bp, Homo sapiens
tggataacttatttgttactgactgtgataaaaatagagtgtacattgtacagtttactacaggtgtcattaattttctcattctctcatatgcattgagtaactaccatacagcaagcactattctaggaacaggtagataagatttattagtggaaaatcacttacctaaaaccatatcatataaccgtgttaatgcaccttggtgtatgagaaactttcaactacaaatatttgattaccttaattgcaattcttaagggaggctaagtagatggatagctgaataaagttattacttggaaatgttgccatgtagccgcaggagccaatttcagtgcacacatcttaagcatcagtgtacacatttataggtctttggtgttttggccagcagaacccacctgggttatggaatcacactggtgtacttgatcgtgttcgggtatgaacatgctctgatttacattgagtactaattgagcatgtctatttaaattaaa

SEQ ID NO: 28791 - DNA, 900 bp, Homo sapiens
gcatgaatcagtttttttagtggtgatttctgagattttgttgtatccatcaccagagcagtgtacactgcacccaatgtggagtcttttatccctcaccccactcccaccctttcccctgagtccccaaagtccattgtattattcttacgcctttgcaatagactttctgttttaataggaaattgctagctttgatgatttgtgatgttttgtaaaaaatgttgaaaataactatttaaaaaactattcttcgtagcttcaaaattctgtactgtttgaagaataattacaatacttatttagggagaggcaccaaatacatattttaactaacattaaagtcaattttaaagtacttacaataaagaaaaagttgactttttaataagccagaagaaacttagtctgggttaaatagctttatccttagcaaaaatgaccagacaacctctcagaattttaaaggaagacttagagcccttattggtagctatttagttttcaatgactacatacttatataatttcataaaaattattggaagttatttccctttttacccttggatattttgagttagaacattatttttaaaatcttataagcacagtagggtaaataatcacaaacatttatgttttttaaagaaaaagacaccttactgaagggcaaatgaccctatattattagatttaactattcagtcaccgtaagaattacaatagcatgttttatacaatgtgtgaatcgtaactctaggtctgcagttataagacccctgaaaggcaaacttctggcatttgatcatatgtattgctgaactttccagatctgggtggggtatccaaacctggaattgttataatactatgcagcataagcatctaaagtttaaa

SEQ ID NO: 28792 - DNA, 374 bp, Homo sapiens
ggcagttaatataaatgctttctgttttgtaaaataggaacagtatttgattccattatcacagatctcttgtggacaagtcaaaattcttcaattaaggttatatctagttaaaggaatttttctctttggtctacatccccaccctgaatgtccttgcctgttagttccttgcaggtgaaaggtaaaaaacctttgcaacttcatgctataattgtgcctttgaattttcagaggaaaagacagtgagagagcaagagcagattgagaagcagaagagtgagtcgcaaaaagagaaaatgacagaaatggagcaccctgccacatgctcttcatcctgtggtttttttccaagctaaagatgcatgtcgacg

SEQ ID NO: 28793 - DNA, 420 bp, Homo sapiens
gaaattctttacgaaataaattagtgaaatcaaaacattactttagaccatcaaaattatgcaaattctgcctgtcttcacattttttagtcaatttattgccaatgcggtgtgtatattcaatattctaaggatttctgtgggaataacttcattgtaagataaacaagtttagtcactgacatataaatgtagccactggaataaaaatgaaatgggtccagcctattacagtacccagaattttccatatgtctattccattgtagctgccaaagtcaccattccttgtcaacctctaattggacaccaggcctaaaagccttcaaggatggggagagtccttttgagctctcggatccaaaacttcaacctactccaggcttagttataaacctattattctgtaactatgaaaac

SEQ ID NO: 28794 - DNA, 457 bp, Homo sapiens
ggtgggaaagtgaggtttgcatagaattagggaactgtaatgcaaataaaagagcaacagtgaacttaacagcccggttaaactgtctatagtggtagacctataatacgacacataaataagcactgtagtatgtaacttgataaaataaagcaaatacacaaaactccatcaaacgcatgtaatcatctaccaactaataacctggggactatcaggcagcaaaaagtgtacttggctacctttggcccctgttggattcctactctgtgccacaaagtatgctctagaggagccaactacagacaccgtagtatcatgtgacacagtcttatcctaggcacagagaacaggattcaacctttggaaggggaaaggttacactaaagttgacaccagagcacaagtattgagagagatagtacagcaggcagaaagttcagcatgttttctaaag

SEQ ID NO: 28795 - DNA, 4158 bp, Homo sapiens
  misc_feature (1239)..(1239): n is a, c, g, or t
  misc_feature (1935)..(1935): n is a, c, g, or t
  misc_feature (2602)..(2602): n is a, c, g, or t
  misc_feature (2688)..(2688): n is a, c, g, or t
  misc_feature (3034)..(3035): n is a, c, g, or t
ccgtggtcccggcgccgggtcccggagacagacgttacgcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgccagaaatggcaatgctgaagaagtaagacaactattagagaccatggcgaggaatgaagtgattgctgacattaattgcaaaggaagaagtaagtctaacttgggctggacacctctacatctggcatgctattttggacacagacaagtggtccaggatctgttgaaggctggtgcagaagtgaatgtgttgaatgacatgggagacacgccgcttcatcgagctgcctttacaggacgaaaggagttggtaatgcttctcttagaatataatgctgatactactattgttaatgggagtggacagacagcaaaagaagttactcatgctgaagaaatcagaagcatgcttgaagctgtagaaaggactcaacaaagaaagcttgaagaattacttttagcagcagcaagagaaggcaaaacaacagaactcacagctctgctcaacaggcccaatcctcctgatgttaactgttcggatcagttaggaaatacacccttgcattgtgcagcttaccgggcccataaacaatgtgccttaaagcttctaagaagtggagcagaccctaatctgaagaacaaaaatgatcagaaacctcttgaccttgcccagggtgctgaaatgaaacacattcttgttggtaataaggtcatctacaaagcattgaaacgatatgagggccctctctggaagagttcaagattttttggctggagattattctgggtagtgttagagcatggagtcctttcatggtataggaaacagcctgatgcagttcataatatttatcgccagggatgcaaacacctgactcaagcagtatgcacggtaaaatccactgatagctgcctcttctttattaaatgctttgatgacaccattcatggcttccgggttcctaagaatagccttcagcagtcaagagaggactggctggaagcaatagaagaacattctgcttacagcactcactactgttcccaggaccagctgactgatgaggaggaggaagatacggtttcngctgcagacctgaagaaatcattagagaaagcacagtcatgccaacagcgactagatagggaaatttccaactttctcaaaatgattaaggagtgtgacatggctaaagaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacntacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcaccnctgaggagttggatgaaatgccagtgccggattctgaaagtgtattcattatccctggaagcgttcttctatggcgaatagccccncggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcanncaagtcagggtgtttggctaatctacaaataagtcttaaacctatgtttttaaatttttttcccttggtttctacttatcttttaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttacccccttccatcttccaagaagaaaaaaatgcctgaatattcagaatagatatttctgatttgaaattctaagattaactggaaagtatttcattacttagtgctctgaatttacttttacagtttttctgcagtcagtatcattaaaatggttaagtttcacatttgaactgaaaatatgtataaaatctagcaattcacaaaaatgccctagaaatatagattttaatcaccattacataatgacaaaccttgttaaatgcttcacttccatgggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctccagggcctaggtagctgccagtccgtgattttaattgctgtcttgaagttaacaagtgttataatgaaataatctacctgatgctaaataaaggctttagaatgttccccaaaaaaaaa

SEQ ID NO: 28796 - DNA, 3915 bp, Homo sapiens
  misc_feature (1065)..(1065): n is a, c, g, or t
  misc_feature (1761)..(1761): n is a, c, g, or t
  misc_feature (2359)..(2359): n is a, c, g, or t
  misc_feature (2445)..(2445): n is a, c, g, or t
  misc_feature (2791)..(2792): n is a, c, g, or t
tctcctgcctcagcctcccaagtagctgggactatgggctcaaaccaccgtgctggctttttattgttactttaaatttaatttattgttagtactgacacctaaacaatattaacaattttaattttttaaggccttaatatattttgaaggaatgattttcaccattgtatatttcttggtatttaaagtggtcatgtttactaggctggtgcagaagtgaatgtgttgaatgacatgggagacacgccgcttcatcgagctgcctttacaggacgaaaggagttggtaatgcttctcttagaatataatgctgatactactattgttaatgggagtggacagacagcaaaagaagttactcatgctgaagaaatcagaagcatgcttgaagctgtagaaaggactcaacaaagaaagcttgaagaattacttttagcagcagcaagagaaggcaaaacaacagaactcacagctctgctcaacaggcccaatcctcctgatgttaactgttcggatcagttaggaaatacacccttgcattgtgcagcttaccgggcccataaacaatgtgccttaaagcttctaagaagtggagcagaccctaatctgaagaacaaaaatgatcagaaacctcttgaccttgcccagggtgctgaaatgaaacacattcttgttggtaataaggtcatctacaaagcattgaaacgatatgagggccctctctggaagagttcaagattttttggctggagattattctgggtagtgttagagcatggagtcctttcatggtataggaaacagcctgatgcagttcataatatttatcgccagggatgcaaacacctgactcaagcagtatgcacggtaaaatccactgatagctgcctcttctttattaaatgctttgatgacaccattcatggcttccgggttcctaagaatagccttcagcagtcaagagaggactggctggaagcaatagaagaacattctgcttacagcactcactactgttcccaggaccagctgactgatgaggaggaggaagatacggtttcngctgcagacctgaagaaatcattagagaaagcacagtcatgccaacagcgactagatagggaaatttccaactttctcaaaatgattaaggagtgtgacatggctaaagaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacntacctcatccacaaggccagttcactctctgatcctgtggaaaggatgcagtgtgtagctgcgtttgctgtatctgctgttgcttctcagtgggaacggactggaaaacctttggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcaccnctgaggagttggatgaaatgccagtgccggattctgaaagtgtattcattatccctggaagcgttcttctatggcgaatagccccncggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcanncaagtcagggtgtttggctaatctacaaataagtcttaaacctatgtttttaaatttttttcccttggtttctacttatcttttaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttacccccttccatcttccaagaagaaaaaaatgcctgaatattcagaatagatatttctgatttgaaattctaagattaactggaaagtatttcattacttagtgctctgaatttacttttacagtttttctgcagtcagtatcattaaaatggttaagtttcacatttgaactgaaaatatgtataaaatctagcaattcacaaaaatgccctagaaatatagattttaatcaccattacataatgacaaaccttgttaaatgcttcacttccatgggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctccagggcctaggtagctgccagtccgtgattttaattgctgtcttgaagttaacaagtgttataatgaaataatctacctgatgctaaataaaggctttagaatgttccccaaaaaaaaa

SEQ ID NO: 28797 - DNA, 4089 bp, Homo sapiens
  misc_feature (1239)..(1239): n is a, c, g, or t
  misc_feature (1935)..(1935): n is a, c, g, or t
  misc_feature (2533)..(2533): n is a, c, g, or t
  misc_feature (2619)..(2619): n is a, c, g, or t
  misc_feature (2965)..(2966): n is a, c, g, or t
ccgtggtcccggcgccgggtcccggagacagacgttacgcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgccagaaatggcaatgctgaagaagtaagacaactattagagaccatggcgaggaatgaagtgattgctgacattaattgcaaaggaagaagtaagtctaacttgggctggacacctctacatctggcatgctattttggacacagacaagtggtccaggatctgttgaaggctggtgcagaagtgaatgtgttgaatgacatgggagacacgccgcttcatcgagctgcctttacaggacgaaaggagttggtaatgcttctcttagaatataatgctgatactactattgttaatgggagtggacagacagcaaaagaagttactcatgctgaagaaatcagaagcatgcttgaagctgtagaaaggactcaacaaagaaagcttgaagaattacttttagcagcagcaagagaaggcaaaacaacagaactcacagctctgctcaacaggcccaatcctcctgatgttaactgttcggatcagttaggaaatacacccttgcattgtgcagcttaccgggcccataaacaatgtgccttaaagcttctaagaagtggagcagaccctaatctgaagaacaaaaatgatcagaaacctcttgaccttgcccagggtgctgaaatgaaacacattcttgttggtaataaggtcatctacaaagcattgaaacgatatgagggccctctctggaagagttcaagattttttggctggagattattctgggtagtgttagagcatggagtcctttcatggtataggaaacagcctgatgcagttcataatatttatcgccagggatgcaaacacctgactcaagcagtatgcacggtaaaatccactgatagctgcctcttctttattaaatgctttgatgacaccattcatggcttccgggttcctaagaatagccttcagcagtcaagagaggactggctggaagcaatagaagaacattctgcttacagcactcactactgttcccaggaccagctgactgatgaggaggaggaagatacggtttcngctgcagacctgaagaaatcattagagaaagcacagtcatgccaacagcgactagatagggaaatttccaactttctcaaaatgattaaggagtgtgacatggctaaagaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacntacctcatccacaaggccagttcactctctgatcctgtggaaaggatgcagtgtgtagctgcgtttgctgtatctgctgttgcttctcagtgggaacggactggaaaacctttggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcaccnctgaggagttggatgaaatgccagtgccggattctgaaagtgtattcattatccctggaagcgttcttctatggcgaatagccccncggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcanncaagtcagggtgtttggctaatctacaaataagtcttaaacctatgtttttaaatttttttcccttggtttctacttatcttttaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttacccccttccatcttccaagaagaaaaaaatgcctgaatattcagaatagatatttctgatttgaaattctaagattaactggaaagtatttcattacttagtgctctgaatttacttttacagtttttctgcagtcagtatcattaaaatggttaagtttcacatttgaactgaaaatatgtataaaatctagcaattcacaaaaatgccctagaaatatagattttaatcaccattacataatgacaaaccttgttaaatgcttcacttccatgggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctccagggcctaggtagctgccagtccgtgattttaattgctgtcttgaagttaacaagtgttataatgaaataatctacctgatgctaaataaaggctttagaatgttccccaaaaaaaaa

SEQ ID NO: 28798 - DNA, 1406 bp, Homo sapiens
aaattttaatgataataatattttaaaggtcagataatgccattagaggcagagacaaacctggggaccaagctaatttctctgttattgagagcgctaaagacaggtgaactggagttttatttcctctgctagagtgaaataataccctctccaccaggcacaatggctcacacctgtaattccagcactttgggaggccaaggtgggcggatcacttgaggtcaggagttcgagaccagcctggccaacatggtgaaaccccatctctactaaaaatacaaaaattagccagccatggtggcatgctcctgtaatcccagctacttgggagactgaggtgggataatcacttgaacctgggaggcggaggttgcagtgagctgagattgtgccactgcactccagcctgggtgacagagcaagactccatctaaaaaacaaaaacaaaaacaaaaaaaccctctcaattggtttaataccacgatagaaaagataaatattttaggatggaatcttaaatatgtctgtccttttgtttcatatagttgaaatcaattcagtattgtttctacattaggtgtttcaaaaacagtcacctttgcaacagaagagctcttttgttgaaaatgattcacaatatatttcagttggaatgtcaggtggtatttctcttaccaacacctcacagaatctatgccaagctgctctaccaccaatgcaagtatttttttaaagctactaaaataaactttcttcaccagccaactctaatttggagacagtgtgcattggtgaaggacctcgtcagaataagtttgaatgtctactgaactaagaagaattttgtcgttttgggggagagaatagatggcatcagtccttcaattctgtaactgaagactccaattatagtagataagaattgtgtctagcaatttttaaacactgacagtccaaacaaaaatatttggtgaggaaggatgtcccatatttttgcttaaatatcataaacaaatatgagcatttactaattttttaaatggcattttgaaagattattcttatttacactctaaaattaaaggtgtactttatcttaagaaaatgatatattaaaaattcatattttaaaagataaaattggggaatttacagttattttgtgaatggcctttaaactatgatttgatctatatacaacttttcagaatacttttgattgtgtgttggacatatctaaaattaattttatctggcagaattaaacctaaatttatttgtataaaagagtcccctttctaaaattcatacagtgcccttgtattcatttatgcagtgtttataaatatttcaagttagattgtgagatattaataaatgatttatgctgtgaactgttactg

SEQ ID NO: 28799 - DNA, 955 bp, Homo sapiens
cttaatattacctgtatttaaattctttcttttgcccttattaacactgatatttgaaacaactaatcatctaaaaggaagctcttaaagggctttaaatgtcaatatagtaagattctaatgtgcactactatttatataaaatatttcttagggcccataaatcatataataaacagtgaacccaagagctacatatggagtctagtgaagagttcccatgtagcctaactaattgtatttaaattgaggagatccaaaaaccccatcacccttcaccccaaagaccccttcacccttcaccagggaattctatcctgggtgctgtcccacctatgaccccttcaagaggccattggaaaaaggccatttacaagttaatgttacttatagctttgttactaagactcacctattgttagtgcagccaagtcacagaagtgcttattgcagttaaatagcaatttgtttccatgaaactgcaattaaagtattactgagcagccattttagattggcagtgctctgaacgcatgttaaacagccagctactcccacttgcagagtctgagatctgactagcagcaaagtgtagcacattcgccgatgctgggtacctagttaaagaggcatttgtagccctctgctcccatcgtgaacatgctgagagcaatgacaagtcagggctgatttttggaaggtgaacttgcaacttacctcaagtgaatactgttttcagttgtgcaagaagtgctttatgctagtagatatgtgcatgtttcctagagggaatgttttcaagttcagattgattctgctgagaatggacggcaactcggaggcctcaagccaataatgtactacaggccctgacatgttacagctgtgtaaacagggccattctatttcctaaatcacaactaataaagcagaggatgaaaatcaaaaaaaaatg

SEQ ID NO: 28800 - DNA, 537 bp, Homo sapiens
actaacaatgttgtcatctgtaaaaactgttcagtgaattgtcccttcatgtcttaaatctgttgtgatggtgatttctgtgtgtcaacctgactgggttaaggaatgcccagatagttggtataacattatttctgggtgtatttgtgagggcgttttcggaagagattagcatttgaccagcaatagaccaagtaaagaagattgccctcaccaacgaggacaggcatcatccgatgtgctgaggactcaaatagaggtaataggcagggaggaaaggtgaattcactctctgtgtttgagctgaaatgtctgtcttctcctagcctcagacactggcacttccggttctctggccttcagattcagactgaattacaccaccagctttcatgaatcccagtccttcagacttagactctggactttacatcaaattacaccactgactcccctggctctctacgttacacgtgcagatcgtgggacttctcagcctgcatcaccatatgaaccaattcccattataagttaaaa

SEQ ID NO: 28801 - DNA, 555 bp, Homo sapiens
ctagttgtgcagccgtgactgtttaattaatagacatttacataagctcctgattttcccccagcaagctttataatggtcttggtggttatctccttttcaccctgtgaagtatcagcagtgcattttccattttgcatatcaaaatacagagagattaaattatgtacaacaaattgataattgaataagtttgggaactcggagttctggcatattaatagtcttgcttaaagcaacaatctatatagactctataaatatattcagacactgctctctaatccaggagctggagtggagactgtcagaagcccagggagggagccctttgtagatttatgcaggtgtgggagaattagtttctggcctctctatggagccatgaaagaaggttttgttagtagaggaggtggtatctgagaattattgctatgatgtctgtaatttttaataaaaattctagaaagcctggtggtgtctgtgtagtatatgaatttgatgaactgtctttctttggttttgtttgtttgttgttgttgtttaaaccacctt

SEQ ID NO: 28802 - DNA, 1064 bp, Homo sapiens
ccagctacttgggaggctggagtgggaggatcacctgagccctggaggtcaaggctgcagtgagctatgatcacgccactgcagtacagcgtgggtgacagagcaagaccctttcttggggaaaaaagtcccatataactttccttgatgaccccaccctcacccctcactgtgtcattatgccaagagagctttgggcattctaaagaagtatgaggaatacttgaccaataaccaaagtatagttatttatttgttaatgacttctttcctagactgtgagttactttagagcagagacttatttttccctgtatccctagggtgtggcacatagtaggtgcttagtaaacttattttgcattcaataatgccaagtagaataattcatagattatggcaaaataaaagaatttggcaaaattgcaagattgaagattgctttcagaaaaaatgttccaacccctgttcaaaagtacatagcttgctgtgttgttgaagtgccagcacgaggaggaccatgccaacacatccatttattgcccattctgggtgtgttgagcgttttaagtttgctatgcttgtaaaaatcaaggaatggcaatggtatcaactttcatgaacacagtcgttcagctgaaccaagtatcagtgataacttctgttttgaattttagaaatatatctctgaggttagaatgttgattcatgcatattccagctggctttccctatgagtataaatagggaaaacaaggctattggcccaaatgtaagttgtattccaaggtttggtccaaagaccagagaatccctaagtaggaagacagttttgttttcccctcttttactggttaactttgagcaggtcacttatatttgggggcacagaagatgaagatgaccctgagcttgtcatgttcactgttaattgttctactaacaccctagacttcatcatcttgttatagcacttatcacagttgcttttaaatcatcatgcagttatatgtttattgtctgccttttccactagaataaagcctctgctgacataaggtcta

SEQ ID NO: 28803 - DNA, 443 bp, Homo sapiens
ataattctcttaaagtagtgacttcaccaacaggaattccaggccccctggtgtgccagctcaagggataagcagagtatgtcgggttcccaggtgccaatgaacagagaaatagccaaagggctcgctgagtgggagcagaggtaaatgggcctggataattggaaaactggatagtcacgaggttaactatgccacaggcaagaatccagatggttccaacctacctcagccagtgtgacgtgaaacaaggtcccagcttgaacactctgagttttgaacagatatgtctgagaggacatctgccagaagcctatttgcatgaggaacttagaaacctccaggagaaagctcagactgaaggaaagaggagtcggcttgccaactgcaaggcaccagacaataaataatgccgtagtggtcaatggaaagtagtgaatggg

SEQ ID NO: 28804 - DNA, 580 bp, Homo sapiens
aggcttggtacttttcttcatgaaaaggaactacttctgttgaagatggctagaaaactagatttcatgacccaagaagcaagatagccctagagatcactaatgttttcagaaatgctctgcaagtcatgtaaaggctaattgagaagaagattccattgataggcatggtttagctgtgaaaaacaccgaaaacaagtcagtcaggagatagtgattaaagaacatctaagtttgtagttacgctgaagaaactaaaaataaaagatgcaataacaagtataaaaaccacaagtcccatatactatgagttgtattcaaagtccaagttaataatcacaattttttaaatctacataattaatctatgtcctactctagacaaaatatcatccagtgtctagaatgaaagcaaaatgactgtgcaaatatacaaacaccccctaaaataactattgggtaataggcttaatacctgggtgatgaaataatctgtacaacaaactcccatgacatgagtttacttgtgtaacaaacctgcacatttacccctgaaactaaaagtttttttgtaaaaaaa

SEQ ID NO: 28805 - DNA, 432 bp, Homo sapiens
tttcatcaattctaagacatacattttctttttcccattttaacacctctgaaattgagatgctttttaaaatcactatcagcctgccagcagtcttgatgtcactgtcatatctgggaacacacatcaaaacttgcggaacaagtatttgcagcttaaaatcctgaggacaatagaggagtgatttttaaagaaatgctatcacaaatgcctgcaatgtgacagcagatgatagtctgttgaaaaacatggacattgacaatgctgagttcgtctctgaatatgaggaagttttaggaataacttaaacaattatttcacttatattttccttttcatgtatgtatacaaaggtcttgtgacaaacacctatgtttaaataaacctgaaagttcttttcataagtataaaaataaaattctaagtgataag

SEQ ID NO: 28806 - DNA, 360 bp, Homo sapiens
cactgcactccatcctgggcaacagagtaagaccctgcccccccaaaaaagtagtcctaagtaattattgatttaaaaggcggtgtaggataaaaggtaaagaaggccatttctactgtgggtgtacatggacttcaaattcagagtccacagataatcaaagaaacatttcacttccctattgctgaaataaagaaacaaataaagaaacacactgtatggctctgtttacatcaaattcagaaaagcaaaacatctatcatgaaaaatctgaacagcgtttaacttggggaaggtattgactgggaggagaccccagggaaccttctgaagtgttggaaatggccttatattgatcac

SEQ ID NO: 28807 - DNA, 343 bp, Homo sapiens
gaaggaagtgttaaagtttctatttattttggtaacttataaactttctatttgttacagtgtgagttctggtgtatatagtcaagccatatgctagtacatgggataatgtataaataaacatgtaagtgtcgataagtactcaactcttttttactgagagggctttaggctttttttttttttaagtttcaataccacagttcaaatgtgtgtgttggtcttatctatgtaattgttttgtgtgctctttcagggagtggtggtgtcttgtgtctcttactctgccaaaggaccttgtatgtataaatgcgaataaatatttattgaactccaaaaaaaa

SEQ ID NO: 28808 - DNA, 309 bp, Homo sapiens
cagtagaatattagggaagtcctaaatttaaataccaaaatttatgaaaatcccagcactttgggaggccaaggcaggtggatcacaaggtcaggagatccagaccatcctggctaacacggtgaaaccccatctctactaaaaatacaaaaaattagcggggcgtggtggcgggctcctgtagtcccagctactcgggaggctgaggcaagagaatggtctgaacccgggaggtggagcttgcagtgagccgagatggcgccattgcactccagcctgggcggcagagcgagactccgtcacaaaaaa

SEQ ID NO: 28809 - DNA, 303 bp, Homo sapiens
ttcttttttttaagatgaggtctcacttttgcccaggctggagtacaatggcatggtcatagctcaatgcagcctccaactcctgggctcaagtcatcctcctttctcagcctcccaagtagctaggtctctaggtgccaccaccacacctggctaattttttaaattttattttactttttgtagatacagggtcttactacgttgcctgggctggcttcaaactcctggccccatgtaatctttctgcctcaaactcctgaagtgtgggaattacaggagtgagccaccatgccctgttac

SEQ ID NO: 28810 - DNA, 329 bp, Homo sapiens
attccctggtttctcaagggggtcactttccctctcaccgagttaaatctggctctgttatattttttccaggaacacagtatgtctcttcccaatgttttattcggtttctggtttccccacttttgaccggaagtatgtgggaagaatactggctgttattattatgattattgagtgtccaatactctcctccaatatttccaccaagaattattatcgctgctctcctcattcatgttagtgttgctttgtgtgctttagatgacaatcgtcctctttactctccaagtttggagggtgagggttttttgttgtggtggtggtgg

SEQ ID NO: 28811 - DNA, 500 bp, Homo sapiens
tacctgatggagcaagggcaagaggacaacggtgggaatcgccatgttgggtggaccctcttgcatttgcatcttaaaggttgccagcctttaagagccagggcttttatgctagacaagaaatttttctggagctacgaaaaaccttccaaggaccacttttcctctccatttgcctaaaataatttcttaataactcgtgtggagtagaggggtatttctttttttctttttgttagtcctgtcctgcattctcttaaaaaatcctatctataaaaaatctcagccgggcgtggtggctcatgcctgtaatcccagcactttgggaggcccaggcgggcggatcacctgaggtcaggagttcaggaccagcctcgccaacatgttgtgaaaacccatctctactaaaaataccaaaaattagctgggcatagtggcgggcacctgtaatctagctactcaggaggctgagacaggagaatcgcttgaacccgggaggc

SEQ ID NO: 28812 - DNA, 437 bp, Homo sapiens
ggaaatatttactgtaccaaaacctattgaatgattggtccagaggttctcaactgggcacagttttagccccccagggaaaatctggccatgtctggagacatttttggttgtcacagctgggacactgctactggcatctggtgggtagaggccagggatgctatgaaatgtcctacaatacccaggccagcctcctacagcaaagaattacagcccgagggtcgccagtgctgaggtcgagagtccaggacggatctcatagctcccaacaagatcagccatggagaattgttttgttttgttttttctctgcccccggggtccttcccatgttttaaaagattttttgtctactaagtgaaacgcctaagtcaccatatattttacatttaaaaacattaaaactaaccagaactttctaatcagtccatcca

SEQ ID NO: 28813 - DNA, 4155 bp, Homo sapiens
cactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtctgtgacagcaaatcctacaagagcaaggagccccatgagttggtgggcagcagcccccaccgagaggctagtcctatgcctggtgctaaggaagctgggcagggcaaggatatgatggaagaggaagccccagaggagcgggagagcactgaggccacccagagcaggactgtcaggaccaccagaaagggagagatgcctgtttcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtgg

SEQ ID NO: 28814 - DNA, 1204 bp, Homo sapiens
gatgtgctggaagggatgttcagcgaaggaggttctgggacctgggaggggccttacctccttgctctgcttggaatagtgccctagctggagatcagtagggtggagtggagagtggaatcattaggaatcaaatccagtattagtacccttcccctataggcagctaaggaggaagagaaagttttagtattctttgttaccaggcagagtctctgtgtgtttcccagttgactgggaaagcagaacatggaagtatgtgggattgattgggaagggcagcctagagaggctctggagacttcctctttccctctgtgactctcctcagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtgaggaaagtatcaagggtcccgagggtatcagagctgctgggggattgtttgctaccaagaattgtaccttactgaattcctaaaaaggcacatatataaataacattcagtatacacatatgtgtacatatgcaaaataaatggaatctgctagaaatacgtgatagattttgttttttaaagagaattctgtgagtaaagcttttggaattggaaaaacaaaataccagttaaaatatttccctcagatattagaaaatgaaataaacctctgtcgtgaaaatagtctctacaagtaatcctggttctctagaatggagttggttggcaggaaaaacacagttcttggtgagagaaggagttgtggaatccaatactctattcggggccatttaaaatccttggagcagggaggcagaggttgcagtgagccatgatgataccactgagctccagcctgggtgacagagtgagaccgtgtttaaaaaaaaa

SEQ ID NO: 28815 - DNA, 401 bp, Homo sapiens
ctattttttgaggatttttaaatttttatttatttatgtattttagacgcagtttcacttgtcgcctaggctggagtgcagtggcacaatctcagctcactacaacctccacctcccaggttcaagtgattgtcctgcctcagcctctcccaaagtagctgggattacaggcacccaccaccatgccaggctaatttatttatttttagtagacacggggtttcaccatgttggcaaggctagtcttgaactcctgacctcaggttatccacctgcctcagcctcccaaagtgctgggaataggtgagatactgcgcccggccaggattttaaagtggaagccccagtttccattccagttttgtttttaggagttgtgtgactttgggcaaaacatttag

SEQ ID NO: 28816 - DNA, 4088 bp, Homo sapiens
cactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattaagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtctgtgacagcaaatcctacaagagcaaggagccccatgagttggtgggcagcagcccccaccgagaggctagtcctatgcctggtgctaaggaagctgggcagggcaaggatatgatggaagaggaagccccagaggagcgggagagcactgaggccacccagagcaggactgtcaggaccaccagaaagggagagatgcctgtttcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtgg

SEQ ID NO: 28817 - DNA, 4245 bp, Homo sapiens
cactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtctgtgacagcaaatcctacaagagcaaggagccccatgagttggtgggcagcagcccccaccgagaggctagtcctatgcctggtgctaaggaagctgggcagggcaaggatatgatggaagaggaagccccagaggagcgggagagcactgaggccacccagagcaggactgtcaggaccaccagaaagggagagatgcctgtttcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaaggtaggtaagggtggatgacgtgtgtttggaaaagagcatagaccacatccatgtggctccctagggttaatcatgatacctgggttacagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtgg

SEQ ID NO: 28818 - DNA, 1921 bp, Homo sapiens
ggcagtcccaccactttggcttcccaaagtgcggacattatggtgtgagccaccatgcccagccctcttttttattagaatttttgcacagtacctggccacaggtaatttctcgtgcttaggtgcatcttgaacctgacagtaccctgagatccttattttcctcctaagcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtgg

SEQ ID NO: 28819 - DNA, 2779 bp, Homo sapiens
cactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtctgtgacagcaaatcctacaagagcaaggagccccatgagttggtgggcagcagcccccaccgagaggctagtcctatgcctggtgctaaggaagctgggcagggcaaggatatgatggaagaggaagccccagaggagcgggagagcactgaggccacccagagcaggactgtcaggaccaccagaaagggagagatgcctgtttcaggtgagtgatttgccaacgcagcccttctgttcctcagtctcgttatcctgtactccagacaggaacctccatgagcctggataaatagccttttcagggatggatataccacctctttcactgatggacccataggaagcccttctgctgttcaggctttttctatcatatggcctcactcctcttgcagaattaagaatgccacaaatttcatgcaattcaacattgtcttgtgttttattccaaaaacccttccccctgtctccaaatctagtgtaatctacatcctaaagactgggccgttctcagctttggcagtaggactttatatctttgcataagtgacattatgccccccacctccacccaac

SEQ ID NO: 28820 - DNA, 598 bp, Homo sapiens
  misc_feature (581)..(581): n is a, c, g, or t
  misc_feature (591)..(591): n is a, c, g, or t
ctattttttgaggatttttaaatttttatttatttatgtattttagacgcagtttcacttgtcgcctaggctggagtgcagcagagagagactccgtctcaaaaacaaaaaaaaagaccagtgaatacagccctcctcctttcttaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgaagtgtcancgtggggatnctctaga

SEQ ID NO: 28821 - DNA, 893 bp, Homo sapiens
  misc_feature (876)..(876): n is a, c, g, or t
  misc_feature (886)..(886): n is a, c, g, or t
tatctataatgacatagctctcccaaccttgctgtgaggaataaacaagagatttttcaaatcagtatattgtgcttcataaatgttaacattgttacaaagcatcagtgaggctgggcgcagtggttcattcctgtaatcccaacactttgggaggccgaggtgggtggatcacctgaggtcaggaatttgagaccagcctggccaacatggtgaaaccccatctctactaaaaatataaaaactagtcaggtgtggtggtgggcacctgtaatcccagctactctgaaggctgaggcaggagaattgcttgaacccaggagacggaggttgcagtaagctgacacagtgccactgcactccagtctcagcaacgcagagagagactccgtctcaaaaacaaaaaaaaagaccagtgaatacagccctcctcctttcttaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgaagtgtcancgtggggatnctctaga

SEQ ID NO: 28822 - DNA, 830 bp, Homo sapiens
ctattttttgaggatttttaaatttttatttatttatgtattttagacgcagtttcacttgtcgcctaggctggagtgcagaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtgg

SEQ ID NO: 28823 - DNA, 3590 bp, Homo sapiens
  misc_feature (3573)..(3573): n is a, c, g, or t
  misc_feature (3583)..(3583): n is a, c, g, or t
cactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtctgtgacagcaaatcctacaagagcaaggagccccatgagttggtgggcagcagcccccaccgagaggctagtcctatgcctggtgctaaggaagctgggcagggcaaggatatgatggaagaggaagccccagaggagcgggagagcactgaggccacccagagcaggactgtcaggaccaccagaaagggagagatgcctgtttcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgaagtgtcancgtggggatnctctaga

SEQ ID NO: 28824 - DNA, 2667 bp, Homo sapiens
gatgtgctggaagggatgttcagcgaaggaggttctgggacctgggaggggccttacctccttgctctgcttggaatagtgccctagctggagatcagtagggtggagtggagagtggaatcattaggaatcaaatccagtattagtacccttcccctataggcagctaaggaggaagagaaagttttagtattctttgttaccaggcagagtctctgtgtgtttcccagttgactgggaaagcagaacatggaagtatgtgggattgattgggaagggcagcctagagaggctctggagacttcctctttccctctgtgactctcctcagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtctgtgacagcaaatcctacaagagcaaggagccccatgagttggtgggcagcagcccccaccgagaggctagtcctatgcctggtgctaaggaagctgggcagggcaaggatatgatggaagaggaagccccagaggagcgggagagcactgaggccacccagagcaggactgtcaggaccaccagaaagggagagatgcctgtttcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtgg

SEQ ID NO: 28825 - DNA, 1938 bp, Homo sapiens
gctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagcagggcaggactgtcaggaccaccagaaagggagagatgcctgtttcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtgg

SEQ ID NO: 28826 - DNA, 2602 bp, Homo sapiens
cactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgaggtataggacctaaggctgctgtagccttatgaagggggaaggccacacgtgggagggatattggcctggtgtctgtgctcagcagcaccaactccttctcagtttgatggctttgaagaagtggccctgcctgatgtggaagaagaggaggagcctcccaagatacccacagcctcaaagaacaagaggaaaaaagagatcggggtccaaaatcatgataaggtattttctttgtttatttgtttgtttttgagacagaatctcgctctgtcacccaaactagagtgcagtggcgtaatcttggctcactgcaacctccacctcccagattcaagcgattctcccacctcagcctctcaagtagctggaattacagacaggcgccagccaccacgcccagcaaatttttgtatttttagtagagatggattttcactatgttggccaggctggtctcgaactccttacctcaagtgatccacccgcctcggcctcccaaagtgctgggattacaagtgtgagccactacgcctggcctaaaatcatgataaggtatgccaagttattgaaaattatctatgtttcatgaatcaagccttgcgttttctcactgaacatttctgtggcttactatggccc

SEQ ID NO: 28827 - DNA, 855 bp, Homo sapiens
atgtacggaagctgtcttttggagaaagaagcaggcatgtacccgggcactctcatgagccctgggggcgacggcacagctgggacaggcggcacagggggcggtgggagtccgatgccagcctccaatttcgctgcggcaccggctttctcgcactatatggggtatcctcatatgcccagcatggatcctcactggccgtctctgggagtctggggctcaccctacagtcccccgcgagaagactggagcgtgtatcctgggccgtctagtacaatgggcacagtgccggtgaacgacgtgacctctagccccgccgctttctgctcgaccgactacagcaacttgggccctgtgggcggtggaactagcggcagcagcctaccaggccaggctggcgggtcgcttgtcccgacggacgcaggcgccgccaaggccagttcccccagcaggagccgccacagcccctatgcatggatgcgcaagacggtgcaggtgacggggaaaaccaggacaaaagaaaagtatcgtgtagtttacactgatcatcaaagattggagctggaaaaggaattccattgcaatagatatatcaccatccagagaaaatcagagctggcagttaacctgggcctttccgagagacaggtgaaaatctggtttcagaatcgcagagccaaggagagaaagatgatcaaaaagaaaatctcccagtttgagaatagtggaggctcggtgcaaagtgactctgactccatcagccctggggaactacctaacacttttttcaccacaccatctgctgttcgtggatttcaacctattgagatacagcaggttatagtctccgaatga

SEQ ID NO: 28828 - DNA, 423 bp, Homo sapiens
tcttgagtagctgggactacaggtgcataccaccacacctggctaatttttttatttttatttttattaaagacaaggtctcactatgctgcccaggttggcctcccaaagtgttgggattacaagtgtgagtcaccgtgcctggtcccatgtacttgaagtcatcactaacaaaatgtatagatattgtataatggcaacagttgttatactgtactttctatttgtatttttattttttctttcttcaaatattcagcctcatctagttgaatctgaagatgtggacctgctgatgaagagggctgattgtatctaacttagggtcttgcatgcagctggcacttaatgcattttattgactgttttagctaacattcaatggacaattcctaataaaaaactccactcccaaaagtatga

SEQ ID NO: 28829 - DNA, 1122 bp, Homo sapiens
  misc_feature (1116)..(1122): n is a, c, g, or t
acagcttttgttctacagcattttaaaatataacaggtatattgaaaagtctgattcagttacaatcagtgtatggaatcacaagaagatccataagaaacaaggtgctggatttctccgttgtgttcatctttttccagtgccatcaaccacctcaaagacactggtttaatattgaatttatcaaatatttattgagcacctacctgatgcaatgttctactgggttggagtggaaaatacaaagactacgatatggtctcctccttttatcaattcacaaataagtagacagatggcatacggttgtaaaattattcagctgtaagtactgtaatcaaagtaaaaccagcatgctttgggtgacattgttccttactgtaactttcagggtcaggccagtgttatatctcttttacagatgaggcatctgagagaataaatgagttgctcctgaatgaattagtggcagaactgatgcaaacccagattctacagtttattcttggcttcttattaatacttttttgtgtgcatgtcatttgaaatggttagttaaaaaataataatgacagctaacatttgttgaccattcatgtgccaggcactatgctgtgagttttgcataattatctgatttaatccttaaaaaatatgaggattcacatattgccatatatgagaaaaccaaggctcacggataaattccttaagaccaacaactattaagacagactaaagtggtctaaaagttttggagagaaagtgactgcatgttggcaatgaagtacaccagtgtttcgtagtttttgaaatctgaattctttaaatgataggtttgatttctaatggattgtggaaatttattgtcactctatagacatgagaatctctgataccagctaatgttttcatttctttctttgttgatttcaaatagatcagaggttggatttatgcaaacctgggccaaaggacagttagaagacggtttgctggtaaatggctgattaaaaagcacagaaagccgaacaagacccaaccaaatttggtaattcatccgattcaaaattgttttggttaaatcaaaaatacaagtacacgaccgcaggaaannnnnnn

SEQ ID NO: 28830 - DNA, 1452 bp, Homo sapiens
acagcttttgttctacagcattttaaaatataacaggtatattgaaaagtctgattcagttacaatcagtgtatggaatcacaagaagatccataagaaacaaggtgctggatttctccgttgtgttcatctttttccagtgccatcaaccacctcaaagacactggtttaatattgaatttatcaaatatttattgagcacctacctgatgcaatgttctactgggttggagtggaaaatacaaagactacgatatggtctcctccttttatcaattcacaaataagtagacagatggcatacggttgtaaaattattcagctatcagaggttggatttatgcaaacctgggccaaaggacagttagaagacggttgctgatgggcccgtgcaacagttgctggtaaatggctgattaaaaagcacagaaagccgaacaagacccaaccaaatttgtggtcagaatcgttgccagacttgtccgggggaggctggctggagaatgaagggaatgaatgaagtgtcagcctctcctctcaggctggagcgcagtggcacgattccaactcatggcaacctccacctcctgggtcaagtgattctcctgcttcagcctcctgagtagctgggattacgggcacctgccaccacacccagctaatttctgtatttttacaaaaatttggactctgcttagattggcttagttttctctttagtcaaatcttcaggaaccaatttattaccattaaaaatgatctaacaagctttatttttattattgttaaaaatcctcattttgaggaacacaaccacaaagtaaagaatgttttcattgatttaaccagtaaaaatcaatatttaattataaaattttttttttcttcagctaaaacagcggaagaggtgatttattatatggttgttacactcggccacaaataaacacagaaatagtccagaatgtcacaggtccagggcagaggaccaacatgggcattttgtttatgagcaaggtgggtctcagaggtgatcggcgatcagagggcgatgaagttctagatccattgagacaagctctagacagtagcatgcagtcccacaacttgtaccagcatccccagcatctggcattccatgtttctgctcctgtggcctccacagtgcaacaagctagcggtttacttggacctctacctcatctttcttcttttgcgcttcagcctgcgcattcgcttcttcctccacttggctctcatggtgcaggtttccaagaaaatggcgctaaggccgagagttaataataaaatatttaaaacatggctccaggccatccagatgccttaacttgggctcaggctcctgatactgatgggtcttttatcttcctctgatgccttttctgtgaattcacctgttttggaagaaaacacaattaaggttatctatca

SEQ ID NO: 28831 - DNA, 1212 bp, Homo sapiens
cccgtcaagctgcacctgagaggtatattgaaaagtctgattcagttacaatcagtgtatggaatcacaagaagatccataagaaacaaggtgctggatttctccgttgtgttcatctttttccagtgccatcaaccacctcaaagacactggttatcagaggttggatttatgcaaacctgggccaaaggacagttagaagacggttgctgatgggcccgtgcaacagttgctggtaaatggctgattaaaaagcacagaaagccgaacaagacccaaccaaatttgcctctcctctcaggctggagcgcagtggcacgattccaactcatggcaacctccacctcctgggtcaagtgattctcctgcttcagcctcctgagtagctgggattacgggcacctgccaccacacccagctaatttctgtatttttacaaaaatttggactctgcttagattggcttagttttctctttagtcaaatcttcaggaaccaatttattaccattaaaaatgatctaacaagctttatttttattattgttaaaaatcctcattttgaggaacacaaccacaaagtaaagaatgttttcattgatttaaccagtaaaaatcaatatttaattataaaattttttttttcttcagctaaaacagcggaagaggtgatttattatatggttgttacactcggccacaaataaacacagaaatagtccagaatgtcacaggtccagggcagaggaccaacatgggcattttgtttatgagcaaggtgggtctcagaggtgatcggcgatcagagggcgatgaagttctagatccattgagacaagctctagacagtagcatgcagtcccacaacttgtaccagcatccccagcatctggcattccatgtttctgctcctgtggcctccacagtgcaacaagctagcggtttacttggacctctacctcatctttcttcttttgcgcttcagcctgcgcattcgcttcttcctccacttggctctcatggtgcaggtttccaagaaaatggcgctaaggccgagagttaataataaaatatttaaaacatggctccaggccatccagatgccttaacttgggctcaggctcctgatactgatgggtcttttatcttcctctgatgccttttctgtgaattcacctgttttggaagaaaacacaattaaggttatctatca

SEQ ID NO: 28832 - DNA, 1256 bp, Homo sapiens
acagcttttgttctacagcattttaaaatataacaggtatattgaaaagtctgattcagttacaatcagtgtatggaatcacaagaagatccataagaaacaaggtgctggatttctccgttgtgttcatctttttccagtgccatcaaccacctcaaagacactggtttaatattgaatttatcaaatatttattgagcacctacctgatgcaatgttctactgggttggagtggaaaatacaaagactacgatatggtctcctccttttatcaattcacaaataagtagacagatggcatacggttgtaaaattattcagctgtaagtactgtaatcaaagtaaaaccagcatgctttgggtgacattgttccttactgtaactttcagggtcaggccagtgttatatctcttttacagatgaggcatctgagagaataaatgagttgctcctgaatgaattagtggcagaactgatgcaaacccagattctacagtttattcttggcttcttattaatacttttttgtgtgcatgtcatttgaaatggttagttaaaaaataataatgacagctaacatttgttgaccattcatgtgccaggcactatgctgtgagttttgcataattatctgatttaatccttaaaaaatatgaggattcacatattgccatatatgagaaaaccaaggctcacggataaattccttaagaccaacaactattaagacagactaaagtggtctaaaagttttggagagaaagtgactgcatgttggcaatgaagtacaccagtgtttcgtagtttttgaaatctgaattctttaaatgataggtttgatttctaatggattgtggaaatttattgtcactctatagacatgagaatctctgataccagctaatgttttcatttctttctttgttgatttcaaatagatcagaggttggatttatgcaaacctgggccaaaggacagttagaagacggtacggagtttcactcttgtcgccaggctggagtgcactggcgtgatcttggctcactgcaacctccgtctccctggtttaagcgattctcccagcctcaagcctctgggaataggtggcgaatacacgtgctgattggggcccgggcaacaagttgcctggtaaacgggtcgatttaagagccagaaacgcgaaacagaaccagacacattgggctactctttcaggtgtgaccatggacagatccactcatggcactccagctg

SEQ ID NO: 28833 - DNA, 789 bp, Homo sapiens
acagcttttgttctacagcattttaaaatataacaggtatattgaaaagtctgattcagttacaatcagtgtatggaatcacaagaagatccataagaaacaaggtgctggatttctccgttgtgttcatctttttccagtgccatcaaccacctcaaagacactggtttaatattgaatttatcaaatatttattgagcacctacctgatgcaatgttctactgggttggagtggaaaatacaaagactacgatatggtctcctccttttatcaattcacaaataagtagacagatggcatacggttgtaaaattattcagctatcagaggttggatttatgcaaacctgggccaaaggacagttagaagacggtttgctggtaaatggctgattaaaaagcacagaaagccgaacaagacccaaccaaatttgcctctcctctcaggctggagcgcagtggcacgattccaactcatggcaacctccacctcctggctaaaacagcggaagaggtgatttattatatggttgttacactcggccacaaataaacacagaaatagtccagaatgtcacaggtccagggcagaggaccaacatgggcattttgtttatgagcaagcctcatctagttgaatctgaagatgtggacctgctgatgaagagggctgattgtatctaacttagggtcttgcatgcagctggcacttaatgcattttattgactgttttagctaacattcaatggacaattcctaataaaaaactccactcccaaaagtatga

SEQ ID NO: 28834 - DNA, 319 bp, Homo sapiens
agttgctctgcagaatccactgtgtagccaacttagcagcacccatttattttgcaaagagaaaagtgtctgtatttttggttggataaccagggactgtagtttaggggcatggatttttctttgtgtttcttgtgactgtttcattgtattaatttatttgacttttttcatgtgcagtaatattgaatttatcaaatatttattgagcacctacctgatgcaatgttctactgggttggagtggaaaatacaaagactacgatatggtctcctccttttatcaattcacaaataagtagacagatggcatacggtt

SEQ ID NO: 28835 - DNA, 437 bp, Homo sapiens
tctgttcttgagattgtcacagctattcttggccctttgcatttctatataaattttataatcaggtgatcaatttttacaaaactctgctgggattttgattggaattgagttgaatcaatagatcaatttggggaggtttggcattttacagtatttagtcatctaatctgtgaatacaacacacccctttattagggtttccttcatttgtcttagtgttttgttggagatttttgtataaagtctttcacagcttatttaagacttattcctaggtcttcaagatttgcatgtggttgtgaatgggtattaaaatttttttacccttataattgtttgttaccagtatataggagctaaatttgatttttgtacattgaacttgtatccatgaccttgctaaatctgcttgttaattctagcagtttatatgc

SEQ ID NO: 28836 - DNA, 493 bp, Homo sapiens
accctctgcctcccaggttcaagctactctcctgcctcagcctcctgagtagctgggattacaggggcatgccaccatgcccagctaacttttgtatttttagtagagacggggtctcaccatgtcagccaggcttgtctcaaactcctgacctcaggtgatccgcccacctctgcctcccaaagtactgggattacaggcgtgagtcaccatgcttggccgcaagttttcttcaggacatggccccatgtagtccagctctacaaggtggctgctgtgtgaactaggctacatgccgaaacgggactgtcgggggaatcagcagggggggcagaccaacagccctgtaagacatagcaataatgattataaatagcatccttctgaccgccttttgatgtactgtccaaggccaggtggaaaatctttcctcccctgcctttccccactaatcaccttcccctcatttttcaataaagattctgagcccagt

SEQ ID NO: 28837 - DNA, 1153 bp, Homo sapiens
tcttttataagtgcaaggagttatttccatcagttgacatagatattattcactaaaattttcagcagactcaaaatagagaggagactttaaacttacatgttagcataaaacagacttctctctcattgcatgcactagatcaatattatcatctgtattaagctatctgaatttattcgagacattaagaaaaagacagtacatggtgggaaagctgcacatttctcacaaggaaaaaaacattctatatttgtagcagaaatcagtggtttgaaaagtcatactttgcagatatgaacctgaaaatcaaagtgccattgttaaatcatcctaaagtgtactgtgggtattctccagcatacttgaaaatgaataaagttagattgctcacattgaagctaatggttgagacaagacacctgccagagtgaagtttgattcctatgggtgagaagatgtagatgactattgttctcactaaagttctaaaataatagcaagtgtagagaagagccgttgctttgaaaatacataccacatttgttataaagcatttgtttgttagtatcaatcacataggtagaaagagtttgagttttactgtggattaaaaagccttccctaaaaagagagcatgccagtcatagagacactaatttggcacttttcctccttcttaggtttaaatgttataccaatgcatgtgtttgaaatatccattaagatgatttaaaatttgtcttgtattttgagtttcttaaatgcgtggattcttgttcatttatctctgaatatgtctcttttatattttggcacaattatacacattggaaagggccaacctattagggctcaagtatgtatatgcaaaaaaaaaaagttatatcaaacaggcacagttattacaactagagagaaattccagaaatatttgtttttttaagagaaagtaaattttcacattagatttctattcaaagtactaatatctacatggtccacacttttctattttaaaaaattgtgttctcttgttaaatagattaacatttccacttctgtttatcacaaaagactgtatttgaaatatgcatacggaaaattgaaattatattagtaataaatgtaacttgaaaaatcaaaaaaaaaa

SEQ ID NO: 28838 - DNA, 1068 bp, Homo sapiens
ctgtaaagtaaaagagatacatgattaaaaaaaggagcctagtgcagtttgcaactcaaacaatcaggaatgctttccctcaagacaaccattatatttcagcatgcagccgaagtactttatgtgtacttcccagttcattaaaaaaaaaattatactccaggattgatatttaataaaactaatcattttaatggcttcatcaaaaacattctaagtgaaactggaagaaagatgttatctgcaagtacacaccaatgacaaatacaataactaatggttattaattacttacctatcattgcttatataccattagtgcaaaatgtcaacaccatagaaaaggcaaacaccttagtattattatgaaaacagctctgacctcacagaccttgaaaaacagtatcagggactcctgggagtccatggaccacattttgagaaccactgctttaagaggtgctgcgagaccactgtgaggtctggtgattaacaaaagctttgtggagaaagaggacatgaatgtttttttacctgcaaaggggtgcctcagaaggtcttctcttcagaaacgtcttctaataaattttgcaagacccaatcttccatagcctctaccattgccaatggcgatttccttttcacctttccctttgattcaggggcttttgaggtcaaaagcattttcataatactaaaatgtcctttgtctttttcacttttcattctctcttgagtgtagagtggggttttccagaggctgtatgtgtgatgacgtcatcaggctgaataaatggaatgtatgcttgtatatttttgtgttttctaaagttttccaaggagattggttacagtataaataaaagtgtttttggcttattatttctactatgttcctgctggtatctccaggtatacctactataatctctgtaacttcactatcatccaataagttgttatttttaaaatccaaaagtgttccttatgcctatgcggaaacaccaaaaataagtatatatctttgacttgttttaaaataaaattcaaaacttttttcaactttca

SEQ ID NO: 28839 - DNA, 1225 bp, Homo sapiens
gaggcacttgggcttccatggcaggctgtggccaactggagccgggaggacctgtgctaaatttcacaaggcccaccggttgtcatgatgggggattgtaatgcctcacttcagctttgacatcctctgccttgatgtcctctgcctaaaaaccaggggttcctagacttgaactctgattcttgcccatgtaactacagccgattttccatcagcacagccttgtctggtttccttgcaggcagcaaggattgctctgccccatgcacaagtgtttcctgagactctgatcacagggccgtgatcacaaatacgggctggctgcgggggtggcaaacaaaaatggggtcaggtgcaggcactagtgactgaattgcagtgagcagtgatcgcctgcagaggtgagagcagaatctcctaccaattcaggaggggaggggcacactgggagctcagcagggagcaggggcacatgtcctcagcaacccatttccaattattttttttcttttcttttctgagatagagtgccactgcactccagcctgggcgacagagcgagattccgtctcaaaaaaaaaaagaaaaaaaagtggagacaggggtcttgctatgttgcccaggctggtcttgaacttctaggctcaagccatcctccctgcctcagcttcccaaagtgctgaggtcacaggtgtgagccactgagcccggcctgattttgggtgtttattgagtatctgcccagcaccaggcatggcagactctggggacaccgaggaccctgggctgacccaactgtattaaccggaggttggcgctcatggagggagggaggtggaagtgacaccagtgatcagttatcaagtgggtgcattgtcaccatgcatgcttggttgggggcaggagccaaactctgggggagcacccagccaagaaacctgacaaggggtcacgtatgctttgtccaaggaggaggtgaccctgaagggagagctgtcggatgtgcgggatgatggcaggcgagccttccagacaggaatggggggtgggcggtcagtggggcaggggtgtcagaggccaaaggaaagctggaagggctctcccagcctggggcaacgctggtaacaactcactggtatttcctatttcttcatggataactgtgtacacattaaatagttattaataattaataaaaccattttataatgccggttacaaaaca

SEQ ID NO: 28840 - DNA, 915 bp, Homo sapiens
tggtgctggaggtggctgcagagagccacttgtcccacgtcaccatttcatctcattgtaggctcacctggcacagtggccaagcaggaaggggccaccagtgcatagcccatgctgaagattcagacaggaacctctttccctgttcccagagaatgcggctgagaatgagaacgctgaagatgatccagtccactgaggatgggtcctgcttgcagaagctgccctttcacccatcttgacaagatccagccacccaggactcacccatgcctggtgttccagcttcagggggtgtgcgtggttcctaggtcctgtggacatcacagcttcaggcctgaagagcagagaagccctgttctctgcatgtaggaggtcagcaggggtgggcaggcccagctggaggcagctgggtgagggtcctggttccagcagagcactggggcccatccaagtttgttctgcctggctcagcctcccaaagtgctgggattacaggtatgagccaccatgcctggcctccatgtctaatttttaacactgtcacttttttacaaaactgaaaaaaaaaagtcacccagagaggggcagtggcttgcccaaagtttgtttcttcatttattcactcattgatattaatttaatttaatttaattttttaaacagtgagccaccgcgcccagccagtactttcattttctataacaataaacaggtatttcaaaatatctgtactgtgatgaatataggaaggggtaagaccatgttggaagcgaatttcttcttattaggcatattctggtaccctgtaaaactctgttccaaagtctgaggctttagagactggtttaaaattccaccccttcaccattttgaatggtgtaccattttagggtaagccaatagtcatccaag

SEQ ID NO: 28841 - DNA, 437 bp, Homo sapiens
gcctcccaaagtgctgggattacaggtatgagccaccatgcctggcctccatgtctaatttttaacactgtcacttttttacaaaactgaaaaaaaaaagtcacccagagaggggcagtggcttgcccaaagtttgtttcttcatttattcactcattgatattaatttaatttaatttaattttttaaaagtagagacaggccgggcgcggtggctcacgcctgtaatcccagcactttgggaggccgaggcgggcagatcacgagatcaggagatggagaccatcctggctaacacggtgaaaccctgtctctactaaaaatacaaaaaattagctgggcgtgatggcgggcacctgtagtcccagctactcgaggggctgaggcaggagaatgacgtgaatctggaggcggagcttgcagtgaggcgagatcac

SEQ ID NO: 28842 - DNA, 361 bp, Homo sapiens
tgccttgatgtcctctgcctaaaaaccaggggttcctagacttgaactctgattcttgcccatgtaactacagccgattttccatcagcacagccttgtctggtttccttgcaggcagcaaggattgctctgccccatgcacaagtgtttcctgagactctgatcacagggccgtgatcacaaatacgggctggctgcgggggtggcaaacaaaaatggggtcaggtgcaggcactagtgactgaattgcagtgagcagtgatcgcctgcagaggtgagagcagaatctcctaccaattcaggaggggaggggcacactgggagctcagcagggagcaggggcacatgtcctcagcaaccc

SEQ ID NO: 28843 - DNA, 560 bp, Homo sapiens
ttttattgttttttaattgtgtatatttaagacatacaattcgatgatctcatatatgtctacattgtgaaataatcaccacagtcaagataattaagatatctgccacttcacatagctctctctctctctctcttttcttggtggtgagaacatttaggatctaccctctcagtacgttttaagtacataataaacaccgtgttgttacctgtggtcactttgctatgcattgggtctccaagccttatttatcttgaagaaatgaagctttggacccctgggccagcacctcctcatttcccctttccctgcctctggttcccatgcttgcactctgtgcttctgtgagtttcactcctgtagactccatgtgtgagggagagcgtgtgatgtctgtctttctgtgtctgcctcttttcaccctgtgtaatgtcctccagatttgtacatgttgttgtaagtaaccagatctccttcttttgaaagctgaagaatattccatatatacacgtatagatgtatgcatatattccacattttgaaaaagtcaaatacat

SEQ ID NO: 28844 - DNA, 867 bp, Homo sapiens
gagcccgtcttgatagtttctggtctcgggttcaggcttgggccctttaggtcgggcagtgaatccctctacccttctctttctcctgaagcccggctcctggggccggcccagaagctagccaactacgcgggaggccccgaagcgccgcttgggtcgcgtctcccgcaggtcctctcttccggggctgcctcctaccctttgcctgggtcgcgctgtcctgtcgctcccgccggtccgtcctttcccgccctctcctcgcttttgctcaggcccccaacgccaccgtcacaccccttcccttggctgtcacactgcctgtgaagtttagatgaatatggaatttgctctcccccttcctgtgggattctctggtcctcaaactctcctcactcttggtcactccccctgcgggtaggtggcccacatctcatgcccaggactaatagttttccccaagtatcagttatcttcttccttttctgccacttcctttttctactccacatccaggtctcagatttccttggggaagggtgaagctctgagctggattgggaggggaacagagaagggaaccagcaggctctcgaagggactttggagtctgagaaacctggtttgagtcttaaagcgataaactgtgtaagttagggcaagtcacttcccttctctggcctctggtttcctcattagttgacaatgacaaaactgacttcattgaactgttgtgaagattaaatgagatgatgcatttaaagtacttcacacagggtccgtccacaggttggaactcaattatattaaatgtgattaccttttgcctttttttttttttattttgagacagggtctctctctgtcacc

SEQ ID NO: 28845 - DNA, 2140 bp, Homo sapiens
gtgtttttaaaggtttttaaaatttaatattatgatgttaggtatcatattagtgtgtccaaaatagccacaaagaaagagatgatactgttgaaccagaaacttgaaatcctgatttatctgcttcgaggaacaaaatcaattcctcaaaaccttataagacaaaatatattttaatgtcatagtagttaggaggtatcaaactcagttataaatagggggctttaattcccatagtgatagaactttttaggcacttcaggattataatacggtaacagttttcttccctgccactctggggtgctctctgaagcggcatctccggcagagaactccatagtgtgtgatgagcctgctgcttgctcagtattggcatttacctcttaatatactgtcctatgcccatctggagtataagcctcccagaggagactgggcagagattaacttggcagtaaagattatctgacaagtctaatattttatgtctttgtaattccccattttcaagtatatatctcaattagtttatcttgatatgtgctcaaagatataaactattgtcatcccatgtttatgctattacacatagctttttatttaaagttctggtcataaaattctggttcaaacattctagaattcccagcttctatttctggagctgtgactctcagtcagtcaatgcttaggccatgcctttgaggcactaggtattgaaagttaccacttcttcattatcttaggattctcagttctttcttcaaaacttatactttcaggttttcttaattaactggtcattccatacatctgtgtaaaataatttctaggaaaactccgaatctcaaaacctttgttttatacttactacttcatttccagtagatggcaccaaacaccctttgaaggtcttcattatactaatccctagttggtgttgctggctaattgataatttcatccaccaccaaggaacgaacatggtctattcttcagctgattctctaatttttatataatgtagtatttttgtttggagtctaagctagacttgttggcatttaaattatttgctgtttctggctcagatttcaaccttttttccccctttttaagacaaaaataagtgtgactttctggtcagggtgattgtagaggaagggtcatgatactgaaataggacttggttaaaataaagagttgagagtaagagactaaagacatatgccaaatgtttgtaataaaattaaagagaaaatataaatatatacaaaatccaaaatgtcaggataatgaaatcaaagcatttttagtattatcactttgggtactttagtagaattgcactcgtttatgattttgaagtttgttttacaaataacatccaatttaaaaatactcttttaaaacttagatccttttatagttcataaacatagtaattaggtgttcccattgcatgtatgagatgtgcctcccaaagagcttgttacagcgttagtacattacctgtctgatatggagaaaaaaaactgttatatttctaccttcatttccaactttgtattgtgctttgaaaacctttaccttcagtatgtgtatttcattagtattttcataaagaatcagtttttagatccagttaaccactgaaaccagaatatgcctatatgtcaggcatgatttactacatgtttattctatttattgagttgatttaattttagtgggtttgtggacattaaaaaatacatgtttaatatttcccaccataattacatttacacctttgtctttctttttcttcagtacttgagttgtcagtgttttgtgactcagtctggaaatctgtttaaactaccttgtctttatacaactaccaacaggaggattggtaatttgggctctgggtgagacatacataggttcagtttccatgtctgcagctgaatgcatgacagggaaaatcatttagcctccctgggcctcagtttcttcacgtgcaaaatgtaattaacacaacctacctcatggggttatattgaggattagagataatgtaggtaggatacctacacatagtaagctattatatattggcaacaataataaacttttaaaaaaagaaatatgt

SEQ ID NO: 28846 - DNA, 2279 bp, Homo sapiens
cgacaaagcccaaagggaggttttggatgattaggctgtgtgtgcgtgtgagaatgatcacatgtggcgtcatgctttgtacagagcctcagaccactgggccttgtccagtgagagtcctctctggcgacatcacacgcggagcagccaggggccaccttagatctcagatctctcagagcaatacttttctgaactgccactgtgcctgggtggttgggtttggtgtcatgcttctgactagagtagatcgcgcatgtccaccagtgatacgttgagtccttacagttccccccatggagtcccataagcagctccatcgagatctgtcagcaagttgcaggaccccacaatgttctgacatgttaagacccccttacatgacgagtagagaggcagctgaggccacaaccgtgtcttcctcttgaatggagctaactcggaaccccccgttttctcttcctttctgcccaccactgaacattgccttttagataactcagtgtttcttctagatgtcatagcaatagactttcactttcatgaagtttgggtacgatttggattctcgcttaagtacatatatttatcaatatttttataaggcaaagttcacttaaaaaatctttccaagtagcagtgtgcctaagatggcaaaatactaaaaactggtgtttcctgctcctgttgtgtgtcacttttcaagccgattgaaatatttctggcttttagggcattactttttaactatctcctttaaaaacgatgttctgtaggtttagtgtctttgttcatttccaaaagagtccagacaactgtgtctgcccctgcagaggctgtttgtccaaaggcagcatgccgcttccaccggaacgcagacagcaggggagcggaattctaaagcagcgacttaaaatgaggaatccccaattgcactaaatggtttcaggattgactaatcattgtcttaacattaactcagattttcgatgtgtaaagagctgtgtgacttggcgtctgagagatccctctgctttgctttgcttcagagtcctcgcacccgcatcctcagaactgtggggcatggtgggctctaacgagcactccccttctgttttccttcattacttttgacctccttaagacttcagagagaatgtccgtcaagttcttttctccatcaagttctttaagttccttgaaaggaagggactgtgcaaacacaaagcaatattcttttgtatctgcaaatgcgtcagctggacataccaattggtatcaaatagaataaaatcaaatataaatgtttgagtcttaggttaaaaaggaaggttatttgtatagtttatagataatgaaggaaaaatttctttttcattgcaggaaatcttgtttactggaagatagagtcactcttttcatataagacaaatagtgctttaatgccaacttctttttatctcaacatttcaggatcatgctaggcacactgcccccttgaatagacattatatgcacagttgcaagtcagccaatgtttttattcagaagtatttccccccattatagtgcctgcctatcagagatacaaaaagcatccaacacactaccgtaataggcttctttggggatgagaaatttgagtctcaacaactcagagtttgagatgtcagcttttttggtaaacgtaggtgttagaggtatattttgctttcctacaacaattgttggcccttgatttcaagcatgttgcttcataggaagcaccagagtgccatctgctgcatttcaagagattgtaaatgtcatctcagctggctcagttatatctctaatgtcccgggtagcagcacctccctctaaaaatatgtttacttcgctgtttcacttgtattttgtgtatacgaaatggcagcttccgatttctagttggatttgtcttgcattgtttgtataacttgctggtcacccagggctatttgctttttcattgagaaatttggtaggggtgtctagttcagcttttatgttgatccatcctgacttattttagacattgaatttatctcaccacaagtaaaagaacatgtgtattgactgtctttgctaagtttcctaatttttcctaattatggcaattatggatgtgaataagaatactgatgctgtacaaatatttttgtggaaatgtaccttgttaatgtgactatttaaataatatgaaaataagaatactcttgaagaaaaaattaaaatatttactctttggattttgcttt

SEQ ID NO: 28847 - DNA, 522 bp, Homo sapiens
taaaactggaacatacttttaaatgattgaagctacaaagctattggtctttagacttagatctaaagtagtctagaaatttgagactttctggataatgggaaccaaatttactccactcctggaaggatacagaagccaggcctaccacatgaaatttaagactggaatcagactccctcctcaagaaaggaggctaagaaaaactatgttgattgctagggtcacagctcttataaactggagtgtttgggatggcagggggagggaggctagagggaggaggtttagagaaagccctcacagatcagcacaccagccgagctgcttctttgcttgaggactagaaccgtggtatcttcagaggccccaagacaagaaataaatacataaacaaataagacttagttatagactgggagctctaggcaaaatgcacagacaaatgagggtcaggtgatgggaagaaagaagattccacttacgatgagcatttaaactaaatttccaaaccctaagatg

SEQ ID NO: 28848 - DNA, 647 bp, Homo sapiens
tgtggtggctcatgcctgtaatcccagcgctttgggaggccaaggcaggcagatcacctgaggtcaggagtttgagaccagcctggtcaacatagtgaaaccccatctctactaaaaatacaaaaattagctgagtgtggtggcaggcgcctgtaagtcccaggtacttgggaggctgaggcaggagaatcgcttgaacccgggagacagaggttgcagtgagctgggatcataccactgcattccagcctgggcgacagagacagagcgagactctgtctcaacaacaacaaaaaaaacaagcaatgttaccacagataataacaggaaaataactgatactttcagaatgaaaaacatatgccaatcgtataccatatacaacctcctccaaatgaatctaatatatatttccatatttgtaaattggtatcttaccaattgttacaacgttatacgttaacctttctcaaattaggagtttaaatgatgtattaagaaaatgagggccaggcgtggtggctcaggcctgtaatcccagctactttgggaggctggggagtggacggggaatcacttgaggtcaggagttcaagaccagcctggccaacatggcgaaaccgcgtctctactaaaaatacaaaaaa

SEQ ID NO: 28849 - DNA, 608 bp, Homo sapiens
cccctaatttaataaagactaaaaattaatcccattaggccgtggggagggaggaaaaggtaattttacggcaagcgtttttgtttttgtttttgtttttgttttgaagacagaatttcgttcttgttgccccaggctggagtacgatggcgcgatcttggctaactgcaacctccgcctcccgggttcaagcgattcttctgcctcagcctgggcgacagagacagagcgagactctgtctcaacaacaacaaaaaaaacaagcaatgttaccacagataataacaggaaaataactgatactttcagaatgaaaaacatatgccaatcgtataccatatacaacctcctccaaatgaatctaatatatatttccatatttgtaaattggtatcttaccaattgttacaacgttatacgttaacctttctcaaattaggagtttaaatgatgtattaagaaaatgagggccaggcgtggtggctcaggcctgtaatcccagctactttgggaggctggggagtggacggggaatcacttgaggtcaggagttcaagaccagcctggccaacatggcgaaaccgcgtctctactaaaaatacaaaaaa

SEQ ID NO: 28850 - DNA, 347 bp, Homo sapiens
gttggtttaaagtctgttttgtcagaagctaggattgcaaccctgctttctttctgctttcatgagcctatgtgtgtctttgcatgtgagatgggtcttttgaatacagtacactgatgggtcttgactcttatccaccttgccattctgtgtcttttaattaaaaatacagaatgcttcatgaatttgcatgtcatctttgcacaggggccatgctaatcttctctatatcgttccaattttagtatatgtgctgccaaagtgagcacaatcttttttcatattaatttaaatgtgtaaaatgtagttataaagttggagcatatgatcaagcctgaatgatccta

SEQ ID NO: 28851 - DNA, 468 bp, Homo sapiens
tatatgtgtgtgtatgtgtgtatatacatatgagtaatttcccgaaattttaacttgtcattacacagagaacatcactgtgacttactgttttgatgtgtagggtttaaaaatgcattaaaagtctagggactatttcaaagtaatattctactttgatcctatcagtccttagtgtcatttaatttagtttggacagaaacaacacttgtcatgttttagaactcatggatttttgctgtttactatctttactgcagtcattttgtatattaaaaatgtttagaattcagtttagaattcaggtttctttggggtgaaagtgcgaaacaaaagaccaactcatctaagtgacacctgttataattgagcaaggcctaatctcactgaggtcctcagaaatggaccaactatactcttgcctgactgactcctcatccaaatctatcaagttaaaagttgtcatag

SEQ ID NO: 28852 - DNA, 432 bp, Homo sapiens
agatgctagcactccatcctgctattcccatgctagtaattaaccacagcactgttttcctctgagcttagacttggcctcagaacccttctatagcactctgggtaacaaccctcaactgcttagagttagctctaaaaaacaaaacttgaggccaagcacagtggctcacgtctgtaatcccagcactttgggaggctgaggtgggtggatcacctgaggtgaggagttcaagaccagcctggccaccatggtgaaaccccgtccttactaaaaatacaaagagtagcctggtgtggtggtaggcgcctgtaatcccagctactggggaggctgagaaggagaattgcttgaaccctggaggtggaggttgcagtgagctgagattgcgccactgcacttcagcccaggcgacagagcaagacttcttct

SEQ ID NO: 28853 - DNA, 919 bp, Homo sapiens
tgaatgtgtctttagtccagcacttctaatactgcttttaacattcattacatacatacaagtatctgtggagcactactgtgtgtgccaggcacagtggtaagggctttacataactttttaggataattctcaccaggatctgtcaacagccaccatcaccccccttctacaggcaggaagtagggtccctgagagacccagcagtttgcttagagtgataggatctgtagaggagggatttcaacccagggtgctttactgttgagccttctcccttctcccagctaaactgccttaaccacctccagctctgtggattatccgcctatctaactccatctgcagcccccaccctcagctgcagcctcttgggagtagaatacccccaaggttgacctctgggtcccccttggcctcaccccatagagggagctggggatgatctgttaactaatgtcaaatcgatgcttgagctttcttatgaaattgcatggcagtaaaacctttggctccaaagactgtagccaatactacatgcataaaaatagtctagccgtcaggaaaatccacagttgagtgttagtggctagcacatgatttccttgacactcagggcttttgtggttgaaaacaggggcttttgagtgccagcggagcctttttcttaaagactaaacctaaataacatcagtgctattcaacacaaggcttgaaacttctgacatcacttgttcacccctggtctgggcagctctgtgttaggtcaaaatcacaaccaagcagctgacacagcttctgcacatccaggggtgcatttgggagccactggttgcctctttctgttccctcttgcccagggacaagccacagctcccagacttttgaagtaacttaaagaatggaaatgtgtgcctaa

SEQ ID NO: 28854 - DNA, 291 bp, Homo sapiens
tgggaggatttgtgctgtccttgatgctaaccttgactacagtgtcatggatttatggaagagctttacaattgcaaatgtagttgtgctttttacagaggctgtagatgccccaaagcccaagacagtcagtgcatgttggaagccattatggaatgaggtagtcagtgatttcaggagcttccccattattggtgcagaagtcaggaatatggttttgtttttgtttttgttttttttgagttagagtctcactccagcctgggcagcaagagtgaaatcccatctcaa

SEQ ID NO: 28855 - DNA, 163 bp, Homo sapiens
tggaatttccaccaggtaacacaaaattctgctcctttacctcataaagtaaaaataatggagataattaggtttatttagcattctccagatgtttttacgtcaaaaatgaagagagaccttttattttttcaacttaacaaaaaatggacatatcacaaaa

SEQ ID NO: 28856 - DNA, 590 bp, Homo sapiens
tgttggtaacacaggggtttgcttaataatcctgatcctttaaacaatgtgtaagtgtgtttcatttatttttctatatgcatattatatcttgccattaaaaaatcataggtgctgggattacaggtgtgagtgaccgaccgcacctggccaagttagtctctaatttttctaagccttggctccttctaaaataagaaacttgaagtaaataatcttttcatttccttctaacagtaatattctacaatttctcccagtctagttttgagcacatgtatgattttaaaaaaaaacaataataaaccggttactcttaaattagaggtgatgggagggtagattgatcatttaaaaaaataatttgacattatgcagtgaaattgaagatttgtatatgagaatgtttatagcaccactattcataatagctgaagattagaaacaacttaaaatatatcgacaatatgttcatcattaattaaggtatatttatgtaatcaaatactgtgcagccatgaaaccatagcaatgatagggacgaatttcaccagcatgatgtagagtaaaagaaccaaagcaaaaaaaaa

SEQ ID NO: 28857 - DNA, 540 bp, Homo sapiens
tattattttatatgtcttaagaaagttctaaaggtattaggaaaatgaatgtcaagctgtatgtaattgtaattagctaagagtgattcagaataatttagactgttaatgaaaagaggacatagggaatagtttttcattttatgccaagtgatttttctgttttattagctagtgaaaccaatgttggtaaaattaagttaacaattttagagtttgtgctagaaaagatattctgaggccggatgtggtggctcacgcctgtaattccagcactttgggaggccaaggtgggtggataacctgaggtcaggagttcgagaccaccctggccaacacggtgaaaccccgtctctactataaatacaaaaatcgtccgggcggggtggctcacgcctgtagccccagctgctcaggaggctgaggcaggagggtcgcttgagcccggaaggcggaggctatagtgagctgagatggcaccactgcactccagcactccagcactccagcctgggcaacagagtgagactctgtctcaaa

SEQ ID NO: 28858 - DNA, 301 bp, Homo sapiens
tccaagagggaaggacctgggctgtcttgttcagtgttgttcagttcctaaatagcatcaggcatacagttggtatacaacaaatgattgttgaatgaacaatgaaggagctagtggtatgctggtaaatgtgaaacaacagcctatggggggtgagagggaaagcgtctgtgaatttctgtgacagaaatatgcccaccatggctaatatcaagctagcagcagcctgtcctcactgaacacagagctgaaaagagacaccatcgatgctcctgaggctgtgcaaaccagctccagtata

SEQ ID NO: 28859 - DNA, 342 bp, Homo sapiens
cacaataatggtaaagttcaaatgaaaagttgaggaaggagggatgacagagaataacatatagctaaaagattgttagtattaatattgaaaagaataaaacattgataaagacaaaatagccaatttacaaaaaagaaagaaatttaaatggccaataaatctatgaaggattatttgtattcatagtagttaaataaatgcaatttaaagcaataagatgctgaccaggtgcaggtgtcatgcacatatagtcccagctactcaggattctgaggaggcagaatggcttgagcccaggagtttgaggccagcctgggcaacatggtgagactctgtctc

SEQ ID NO: 28860 - DNA, 476 bp, Homo sapiens
tattcattctttgacaccttttctccttctgtcatgatagcaaacattgattgtgccaacagatcaatgtgcaattgtgccaatttgcacagacactgcgtagagtgcttttgaaattatttaatactcaaagaccctttaaagaagatctgattattatctccatttttcaggagaaggaacagaggcttaggatagtcaagtaacctgcccaagttacacagcagtggtaaatccaggactgaaaaatagctggtccgattcatacattgtgtttaactactttgccatattaactccctgggatctttctaatccttcaatatttccataaaattctgtcttcttcagcccctttgctgaactcttgcagttattccattgcttctcagaagttgataaattatcctgtcttcattaatgagtcaattgttctttctctaataccccacacttgatcattaaggaatgctatg

SEQ ID NO: 28861 - DNA, 356 bp, Homo sapiens
aagttgtgcttcatttgacatcagcctttcttgtgttcagcagggagatgatttgcagctagagaaaatacagtaaaccctacattgcaatgaacagctttgtaagtaggaaaacagcaggccaaataaagctttccctctggtttttggcagaagtctacactttaatttcccctttctaaccaaaccattaatgaactcaacattataggaagctgtagaatggtgagattatctcaagaccctactctctttgacttcttatccaggtgttcaacaacgctcacttccatcttattcttgttacacatcttattcttgcttgtgagtggagcaatgaagtctataaaaaaaaa

SEQ ID NO: 28862 - DNA, 333 bp, Homo sapiens
cggacttgacgcgcgcgctctgcagccctctgaaggcggggcaatcgcgatagagaaaggcaggagagaaagagacaaaaggcttcagccgcaggcggtaaacgagtgagcctgcaaaggcggcacagaaagcgctggagagtcgagtctttccgggtgaccaagctccgctccaagccactctcttctcgaggggagtcaaggagcagaaagcccttggcgcagcactgggcgcgggattccgcactctgccttttctcgctctctgtacctcattatctccctttggggccggaggagcgggctctggtgtcactaaggaactgtaaaccg

SEQ ID NO: 28863 - DNA, 372 bp, Homo sapiens
tgcccttaaggcattgcttcaaagatctgagttggtggatgatgcagcgcttggcacggtgccggtgacacatccccctaagtgttttctcagtgtgagtcttcatcggcttctctgctgtgccttcttcagcttgtttgcgagttcctggttcatcctgaccaccctgaaaggccgcccctgggactttgcataactcattctgtctcctggtgtgtaagtctctctcctggttcccagcaggagtgtaggaatgagtgcttgtcctggactctgggctgggaactagcacctagtggggactggactaggatgacttgggccaatttcttttcaggctgagcttggatttcagatcagatctcttaggac

SEQ ID NO: 28864 - DNA, 2125 bp, Homo sapiens
  misc_feature (1538)..(1538): n is a, c, g, or t
ccctgtctgatgtggagtttcttgcactgataaggaaaaactgctgaagttgtgaggctgctccaggcagagccatcatctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgaggagtctttgtttacagtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatctaactccatactgaacaaggggctttatgtcctcacctatgacctggaatagtttaaatatggtgttcaaggcaatagtacataatagtggaagaaaattcagtggaaggttattgctattgtcatttgcatagaatttaagtgattgatttaaaaaaactggacataaactaagtctaagnagagggcttctgaataacttcattcattttggcatttgttaagagattcctgggctagaaggttgatttcccaaaaagacagataagagactgacaatttaaaagaatctggagacagagctggtgcttacagagacctgccactcctgtgttcacttacaatttctcccaacaaaaggatttctgtggcaaggagaaaactagcctaaagtttagaaaaagatggtttcttggataacattgttaacaaaaggacttcctgaggactatttattattattttgtagggggcacttcctccttcactaaactggattatcagaacgtattaccacccaacccatattttagaagtttggatttggctgctgattagaaatgaatttcaggctatctcctcctactgaatcttaattgtctgtgatgatggcaacagtgatggggaatctaagcgctggtttgatggtggagatattgaataagtagttgggagcagagttccaaagatgtaatttaagccctgttgcaccaccacacacacacacacacacacacacacacacacacacccctcaagtaaaatgaga

SEQ ID NO: 28865 - DNA, 801 bp, Homo sapiens
gggaaaggttcaagtgcgggttttctccttgaacctacaagattatgggtcaagagctgtgtgcaaagactgtacagcctggatgcagctgctaccattgttcagagggaggcgaggcacacagctgtcggaggagtcagcctgagaccacggaggctgcgttcaagctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtaagtcgcccctcgggtctcattctg

SEQ ID NO: 28866 - DNA, 1850 bp, Homo sapiens
  misc_feature (1263)..(1263): n is a, c, g, or t
agcggagttccaccagatgagcatggtctgaggaagaagacggttgtttttccaggggaaaatagaagtgcccccactagaagggagaatggctgtcaggagggcagaacgacagattcactaaaatagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgaggagtctttgtttacagtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatctaactccatactgaacaaggggctttatgtcctcacctatgacctggaatagtttaaatatggtgttcaaggcaatagtacataatagtggaagaaaattcagtggaaggttattgctattgtcatttgcatagaatttaagtgattgatttaaaaaaactggacataaactaagtctaagnagagggcttctgaataacttcattcattttggcatttgttaagagattcctgggctagaaggttgatttcccaaaaagacagataagagactgacaatttaaaagaatctggagacagagctggtgcttacagagacctgccactcctgtgttcacttacaatttctcccaacaaaaggatttctgtggcaaggagaaaactagcctaaagtttagaaaaagatggtttcttggataacattgttaacaaaaggacttcctgaggactatttattattattttgtagggggcacttcctccttcactaaactggattatcagaacgtattaccacccaacccatattttagaagtttggatttggctgctgattagaaatgaatttcaggctatctcctcctactgaatcttaattgtctgtgatgatggcaacagtgatggggaatctaagcgctggtttgatggtggagatattgaataagtagttgggagcagagttccaaagatgtaatttaagccctgttgcaccaccacacacacacacacacacacacacacacacacacacccctcaagtaaaatgaga

SEQ ID NO: 28867 - DNA, 443 bp, Homo sapiens
ttccgggcaaagagaagagcactgcagtagctccagaacatgacatagaataggagggctatgctttgggccagcttgtcctgtggaccaaataatggaaaaacaaggaatcagagcatgacagccagggacaatgagaacagccccttgggaggaactgtcctccttccatcaccaagggccatcctgaacctcctgtcacctacatatcattcaaaattttagattctggctatcagaatacatgaaaaatatatgactgtgccctgggcaaggtagcagaaggtgctggaacacagagcggagaattgctaatgttttcctgccagctctggtgagatggtagttgctgacagccatgctttgtgatcacagattgtctgcccactcatattgccaagcctagcttgtgatttataaatttattttttctgatcctctaa

SEQ ID NO: 28868 - DNA, 2095 bp, Homo sapiens
caaagtgacagatgtctgtgatgtttcatgacataggttatgatcgagccaatttacaaaatttaataaccaacctaaactcacatacatatttgttaagaagctgacatcagttcagtattgtaaggaaactaactaggtggtgatgatgataaaagaattagggaaaatattttatttgatatattcccttttataattcctaaaatgaagattctatttaagggttataatttatataagtttagtcatataccattacattatgataccataagcagagtgcattatgattctctagaaatataattcaatcagatatgtattatatttatttatgtcacacattttctttactgagaataaaaattatcttattttcagaagctttgtatcaatcagtttcatgtaataagcaacccagatatctactagattatgtatttcttcatttgaaactacactgttttctcctagtccccttgactctactgtgcttatccattctttcacagaaagaaagtaacagacataattcctgttgatgaggctgggattgtttttaagaggagagataataacttcatatttttaaagtgccagtagcctaatatgtgaaacagatcagaatctgttgtgtagtaagtctgctttgttgaagaatttattatgggagtaaagataagaaggaaagagatcaccatcagaaacaagtcagccttttcatgcttttttgagcatttttggagatgattccacttctcaagttattatcatttgtgcatctcttcaatgctattgttaaatgctttagaattagaatattttgatcctttaattaaagtaagccaaacgtctaggcaaaaacagccaatcattaaactttaatagtaattcaaatatagatttctcatacagttttccatgtctgtagaaatcaaagttgtaatgttaagcagagggaaatgcgtgtgatttactaatacacttcaacgttctacttttgaaaggatactcatgtgggtggggcagagaacatagaaaaagatatgatggaaaacctgtccattttctacctgttaaccttcatcattttgtgccaggccctggaagcaaagagaggaagggaccgactgcatttatctttgaacacttgagcatcagtagtactactgagtggccaggggtcttgtctgtcaaagcaaatgataagttcactcaggccattattgactgctgaactctcttccttcccaactcttccttgaaagagaaaaaaatactttgccttcttgctctccttatcaaatgtttttgtacaaatagtgtaagcctgtttaagcaaaccaattaaaataggcactgattattttgatctgtttgtaacaaatgaatgtaagtactatttacatggtgtgcctaggaggagctgaaatcattggcactttaatccatattgtaaagatcagtatcaaaagcatagtgttcttcacctctcctcctcagcatccatctctatatacttgattaaatggaaaagtctcttttatcacctctatgtaaagttttatgggtagttatcgtcagtgtatttaaatatatcttctagtatgttttaaaggctggtcttcaatactgtggagacaaaaaataaaagagcgtatgaaaagtacgttagacttttgctggcattcaagtcatggctagtctgtgtatttaataaatgtgtgttatttatgtcgtgtttgtcaatggaaaataaagttgaatattctgaaatgtcgctgtgttttcttcctgatgtcaactcacgtcaggaatactttacctataactatgttaagtattttgctgaaatcccatttgatgtgctttgtcaaataatagcacaatgtaatgcaacagccccatgctatctggaaaaattagatcattttgttttatattccataatcatgtgcataacaaattattgttgatttaatataaatatgagagttgctcttttccgattttcaacatgatgtttctttgttttattatctcaagattattgttcttaacacagagtgcatttataaattattgtaagctt

SEQ ID NO: 28869 - DNA, 516 bp, Homo sapiens
actaagaaagaaacattacaacgagactcacattttaagattattctaacaaaaacagggtggtcagatggattggagagagctttaatagacaggtaatgaaatccagtttcgcaaactacagcaactaaggcacaggaattggaaatggaaatgagaaaagagatttcaaaaatccattaagacttttagtggcaggtgaccttaaaaacacagatgatgactctagctttttaaattgtgataaaagaaaggaaaatgaactataaaaggaagaacatgttttgaaaagttatatttagttttgggcacagggtaatcttttacttaatcacagaaaacatcaagtcaaagtagtatatctcaaactttagtactatttaaaaaaaaaaattctcaggggtcacactgtaccaggttaagttacaacattttacattttatatgaacatacacacaaatgatactaaattatactaggtataaatctcttaggcttattgctcttacacaatt

SEQ ID NO: 28870 - DNA, 3719 bp, Homo sapiens
  misc_feature (264)..(264): n is a, c, g, or t
  misc_feature (428)..(428): n is a, c, g, or t
  misc_feature (1830)..(1830): n is a, c, g, or t
  misc_feature (1957)..(1957): n is a, c, g, or t
  misc_feature (1975)..(1975): n is a, c, g, or t
  misc_feature (3078)..(3078): n is a, c, g, or t
  misc_feature (3649)..(3649): n is a, c, g, or t
gtcttgctctttaattgtaactttacagtgttttcgctcacgagccgaaacttcaagttccctttttgccagcagagtttgggttgcggtcgctggaaaacttgatgcgcactgaaatctcttggtctgtgcatgaggaagagtggatccagcttcttgtcttggctctctgttctctgaatgccttgtactttttgcttttctatcttaccattttttttttgtttgctttcactgtgaataatatattttcatctttccttnccttgctttttttgctgacagaaaatggtgaatgcacaccgtgggtgcagtgagggcttggtgcctgctacgtgggcagcttccacctgtggctggcttattgggctacttggagccacagaatcattgctgagctccgatgtgccagagagtcccaggccatntgggtcactcttctagcttgggaatcttaagtccagctttttggatgtcatcctccctggagggggagctcatgaaagtccaaggttcgagtcttcctccccagagggctaccctgtaatgccgtgggggggtgtgtgtgggggtggcagggaagctctgtcagccttggctatggctgatgccagtcagggtcatagacacctgtttgttctcccctccctgccacaaacgttgaggactgtgaacattatgtcactgtgacctgcttacaatggtaactaagcgttaggcagaaggggttgaggaggggggagacataggctcttctgtaatagtatggtgtcgacatggtgttctttcccctcccttttagctattgaaacaatccacccggtagagtgaacagcttgaggttgatcctggcctgtgataagagccaggtcagtatacttgttagggacatgtgagagacctccccgccacactgcagcattcacagcacctttcctggacctcctgtcacctcgcaggtcagggagttatgtcccctgggaacccagggcttgtccagagctacccacagttgtctgcatttccaggtagcccgattttggggttctaggatgtttcatctcctgggggggtaatcaaatccctggaagaggacaagaaagactgaggtaggaataaagttcttttaaacctcaagggtgcccattgcaggttatcaaaactcacttggtgaaccctgaagagggagatgggtttggtggaaatggtttctccacttgcctatttggcctcttttatgatgcttccaaggaatcttgaattcagcacagtcaaaaccaaactcaggatcttctcttgccaaaagcagtcccttcccagggccccttctgggtgtctggcaccgatatttgaacactcattgccataagccagaaatatagaaggcgatctgtgtaccccctctctgttagcatccatacctagtccacctccaagttctgaaaaatctctccagctcttcacttgaatctgcctgccttctgccactgccctggtccaagtcaccatctgctcatgactgaacttagagtagccttcgtctggtccacctttatctgctctgactcacctctagtgctttctccattcttctgccatcctggtcttttcagagccataacatttgcttgtcacccttattatgaaaaaccaaccacttggtggccttctgttgctcttgggacagatcttcatgtggcccacaaggctctgtgcagcccagctttgtctccctgccagccttgtcttacacaccgtgttgtccatcgtatctgtagcctggccataccctagcagttgccttcctatcctcaactacatcacatgctntctggcctcaggacctttgcacatgctgtttatgctacttggagtgttttgttcctttcttcaccctcagccactccctctggactgcactccacagggcagaagctgaggatgttcagaagcccanacggagttggctgccctntgggacccaagcgagttgtaaacattctggcttcagatgtaaatcaaaggcagagccctgagttttagggcagagaattccttctatcagctctgcagtgagccctcacaggcagactcgggcccaaatatagcctaggtgctgtttatgtatttgaaagtatttaaggctggtccttctgtcatcggtcctccaaagtcttttattacattttgggactgtggtatatagagttccaaatttctttctcccctagagcaaatggtttcagtttactgtaatgcataataaacatgtaaacataaataggcacacttcagaccaggttttccctgtagcttagctttctcggctaaggcccccttccaggtttttgggtcggtgtggtcccaggttatgctcagactcgcccttcatcacctcctccttggcctgcgaggcggtcatggcttcttcgtgactcatcttcgtggcactggggattgcagggaggcatggtgatgtccttttccagtcacaaggctggactgccaaacgaactgccacagattcctttccagtgccccaagctgaaggaaagcgtgatcaggaagcaggcagcagacgtatttgaacccagacatgctcgaccccctccctgagcaggtgtgaaattatgtatgcagctccatagctccactgaggattctgaagtgatcctctgcacgacacttcccggaaataagtggaaagcttactgcatgactgaaaagtacatatcagtcctgcacccctaggattgccctggactcttgtctaaactgtttgttgttgataccagcctcagaagctggatgcctttaagccatggctagtgtgtttaaccgatcccttttatgaagatcttgtaagcgcgtggtaatagcccactatgctttttaactgaaccagcagagcaaacatagttaatggagagacatttttgtcattccttggcctctgtttatttgcaaaaacgagtaaagtgttacctgcaagtggttcagtgcgtgccggggtgtcaggctgcaggtatgtgagcttgttcaaggcttgtcttgcccacgcagcagtttgagagcccnagagggcgaacgctggggccctgttggaagcggtgtgtggatgaagccacccaggagtcccttctctcctggtcacttatagggcttgcatcactttttaaaggagcactggcccgaggcctagaaaaacagccatgtgggtgggtaagaatcacaaagacattgcaagtcagtcctaactgtctctccaagatggtcttgaatttgacaaggtgatgaagagttggtgctggcaggtttaagaaaacaaacacaaaaccaggttggggtgctgatttagtgccttgctgccttttcagatccctcccctgaactgctggcacctgatgtttgagctatttttgtacctgtctcttctcaaactagatgataagtggcctcagggcagggactacatactcctgagagctgcttgagctcgaggtgtttattttcctcagtaagcattttttttcaggagcatgacttggctcaaaaaaacaaaaagaaaaaagaaaccctcccctcaatttacctgtgtctaaactttggtgaattattctcccatctgccttctgggcagaggagaaangtggaatgcatcaagttcaaggtcttggtatttaagagctggctttaaaggttgccatgttaacaattgt

SEQ ID NO: 28871 - DNA, 1030 bp, Homo sapiens
gtgattcttctgctcagtgagtgctgggaaacagtgctaagaaggatacagtggctagaagtcgtcctgtcgtcctgcctcacagtaacatcgttaccgaattctcagcaggtgaaccaaatgaaatggtcaactgaaagccaaccaggagggtgtctggctgttttggggaaactattcctgaccttattttgactaaaaagttgcctgctgtaccagcaaaaaatcaccatgtaccaacctatccaaacttatccatggatgaatctatccagaagacgggagttccgatgcttgtcttgctctgaatgtctgcttgtcacctgcttagggttatcgactgtgattctgggactcattgttgttctacaggacccctctgactctgtggttttctctactggattaacaatgatagccataggtgctttttttgttgtcctcactggagtgacagccctgtgtacggttacagtcgacgagaacttgcagaaaaccacgaggctaagactaggagtgatacgaaaaagcggaagtctccaaggaactacagagccttccatgactcactcaataatcgctagcacctcgctgtagttgtacattgaaccctggcatcttcgtctttggaactaagtctcctgagcattgtttttaaatagaaataaaatctggctttaaaagagaagactaaatggaaaaagaatctagaaaaagagaatcttgaatacaagttcctgataacttcaaagatcataccactggacataagaactttcgaaagaatttgtacgtgaacaggctgataccattcatgaaaattcgtaggagagagagaagaaaaaaagtccatgtagtgggactagataatcaaaagcataatgttggtcataattttctattgtgaaaatgtgctgattctttgaatggtgggattactccagatttatgaactttttttcttgagcaatgggtaaagtatagcttgtgtaaacaaaggattgaaacatttgcttttgatctctatctg

SEQ ID NO: 28872 - DNA, 943 bp, Homo sapiens
ctccatcttaaaaaaaaaagaaaaagaaaaagaatgcatagtagatgcaattcacagaaaagaagaaaagattctatttacactttttgtatttgagctttcatagactttttcttcccttaaccactgcagcaaaaaatcaccatgtaccaacctatccaaacttatccatggatgaatctatccagaagacgggagttccgatgcttgtcttgctctgaatgtctgcttgtcacctgcttagggttatcgactgtgattctgggactcattgttgttctacaggacccctctgactctgtggttttctctactggattaacaatgatagccataggtgctttttttgttgtcctcactggagtgacagccctgtgtacggttacagtcgacgagaacttgcagaaaaccacgaggctaagactaggagtgatacgaaaaagcggaagtctccaaggaactacagagccttccatgactcactcaataatcgctagcacctcgctgtagttgtacattgaaccctggcatcttcgtctttggaactaagtctcctgagcattgtttttaaatagaaataaaatctggctttaaaagagaagactaaatggaaaaagaatctagaaaaagagaatcttgaatacaagttcctgataacttcaaagatcataccactggacataagaactttcgaaagaatttgtacgtgaacaggctgataccattcatgaaaattcgtaggagagagagaagaaaaaaagtccatgtagtgggactagataatcaaaagcataatgttggtcataattttctattgtgaaaatgtgctgattctttgaatggtgggattactccagatttatgaactttttttcttgagcaatgggtaaagtatagcttgtgtaaacaaaggattgaaacatttgcttttgatctctatctg

SEQ ID NO: 28873 - DNA, 1148 bp, Homo sapiens
gtgattcttctgctcagtgagtgctgggaaacagtgctaagaaggatacagtggctagaagtcgtcctgtcgtcctgcctcacagtaacatcgttaccgaattctcagcaggtgaaccaaatgaaatggtcaactgaaagccaaccaggagggtgtctggctgttttggggaaactattcctgaccttattttgactaaaaagttgcctgctgtaccagggtcttgtcctgtcactctggctggaatacaatggcgtaatcatagctcactgcggcctccatctcctgggttcaagtgattctcctgcttcagcttcccaagtatctgggactacagcaaaaaatcaccatgtaccaacctatccaaacttatccatggatgaatctatccagaagacgggagttccgatgcttgtcttgctctgaatgtctgcttgtcacctgcttagggttatcgactgtgattctgggactcattgttgttctacaggacccctctgactctgtggttttctctactggattaacaatgatagccataggtgctttttttgttgtcctcactggagtgacagccctgtgtacggttacagtcgacgagaacttgcagaaaaccacgaggctaagactaggagtgatacgaaaaagcggaagtctccaaggaactacagagccttccatgactcactcaataatcgctagcacctcgctgtagttgtacattgaaccctggcatcttcgtctttggaactaagtctcctgagcattgtttttaaatagaaataaaatctggctttaaaagagaagactaaatggaaaaagaatctagaaaaagagaatcttgaatacaagttcctgataacttcaaagatcataccactggacataagaactttcgaaagaatttgtacgtgaacaggctgataccattcatgaaaattcgtaggagagagagaagaaaaaaagtccatgtagtgggactagataatcaaaagcataatgttggtcataattttctattgtgaaaatgtgctgattctttgaatggtgggattactccagatttatgaactttttttcttgagcaatgggtaaagtatagcttgtgtaaacaaaggattgaaacatttgcttttgatctctatctg

SEQ ID NO: 28874 - DNA, 1337 bp, Homo sapiens
gtgattcttctgctcagtgagtgctgggaaacagtgctaagaaggatacagtggctagaagtcgtcctgtcgtcctgcctcacagtaacatcgttaccgaattctcagcaggtgaaccaaatgaaatggtcaactgaaagccaaccagggtaaaacagatcttttatttcttgttgttgttattattatttttttttatgtggggacattcaagtgaactgctatatgcatttgcccccagtctctccttgtgagaagtgaatttcttcaacgtttatagaactgaggtattacattattggatgaattaagaaaacaatctaacctgatgtgtgaaaatttctgcttgtgagaatccgtgttatttcaattatccaatcaagagcctaattcgtataaaagaaacacagcagcttgttgctcatctttttatctaaggacggtttgtcttgacagagggtgtctggctgttttggggaaactattcctgaccttattttgactaaaaagttgcctgctgtaccagcaaaaaatcaccatgtaccaacctatccaaacttatccatggatgaatctatccagaagacgggagttccgatgcttgtcttgctctgaatgtctgcttgtcacctgcttagggttatcgactgtgattctgggactcattgttgttctacaggacccctctgactctgtggttttctctactggattaacaatgatagccataggtgctttttttgttgtcctcactggagtgacagccctgtgtacggttacagtcgacgagaacttgcagaaaaccacgaggctaagactaggagtgatacgaaaaagcggaagtctccaaggaactacagagccttccatgactcactcaataatcgctagcacctcgctgtagttgtacattgaaccctggcatcttcgtctttggaactaagtctcctgagcattgtttttaaatagaaataaaatctggctttaaaagagaagactaaatggaaaaagaatctagaaaaagagaatcttgaatacaagttcctgataacttcaaagatcataccactggacataagaactttcgaaagaatttgtacgtgaacaggctgataccattcatgaaaattcgtaggagagagagaagaaaaaaagtccatgtagtgggactagataatcaaaagcataatgttggtcataattttctattgtgaaaatgtgctgattctttgaatggtgggattactccagatttatgaactttttttcttgagcaatgggtaaagtatagcttgtgtaaacaaaggattgaaacatttgcttttgatctctatctg

SEQ ID NO: 28875 - DNA, 960 bp, Homo sapiens
gtgattcttctgctcagtgagtgctgggaaacagtgctaagaaggatacagtggctagaagtcgtcctgtcgtcctgcctcacagtaacatcgttaccgaattctcagcaggtgaaccaaatgaaatggtcaactgaaagccaaccaggcaaaaaatcaccatgtaccaacctatccaaacttatccatggatgaatctatccagaagacgggagttccgatgcttgtcttgctctgaatgtctgcttgtcacctgcttagggttatcgactgtgattctgggactcattgttgttctacaggacccctctgactctgtggttttctctactggattaacaatgatagccataggtgctttttttgttgtcctcactggagtgacagccctgtgtacggttacagtcgacgagaacttgcagaaaaccacgaggctaagactaggagtgatacgaaaaagcggaagtctccaaggaactacagagccttccatgactcactcaataatcgctagcacctcgctgtagttgtacattgaaccctggcatcttcgtctttggaactaagtctcctgagcattgtttttaaatagaaataaaatctggctttaaaagagaagactaaatggaaaaagaatctagaaaaagagaatcttgaatacaagttcctgataacttcaaagatcataccactggacataagaactttcgaaagaatttgtacgtgaacaggctgataccattcatgaaaattcgtaggagagagagaagaaaaaaagtccatgtagtgggactagataatcaaaagcataatgttggtcataattttctattgtgaaaatgtgctgattctttgaatggtgggattactccagatttatgaactttttttcttgagcaatgggtaaagtatagcttgtgtaaacaaaggattgaaacatttgcttttgatctctatctg

SEQ ID NO: 28876 - DNA, 1078 bp, Homo sapiens
gtgattcttctgctcagtgagtgctgggaaacagtgctaagaaggatacagtggctagaagtcgtcctgtcgtcctgcctcacagtaacatcgttaccgaattctcagcaggtgaaccaaatgaaatggtcaactgaaagccaaccaggggtcttgtcctgtcactctggctggaatacaatggcgtaatcatagctcactgcggcctccatctcctgggttcaagtgattctcctgcttcagcttcccaagtatctgggactacagcaaaaaatcaccatgtaccaacctatccaaacttatccatggatgaatctatccagaagacgggagttccgatgcttgtcttgctctgaatgtctgcttgtcacctgcttagggttatcgactgtgattctgggactcattgttgttctacaggacccctctgactctgtggttttctctactggattaacaatgatagccataggtgctttttttgttgtcctcactggagtgacagccctgtgtacggttacagtcgacgagaacttgcagaaaaccacgaggctaagactaggagtgatacgaaaaagcggaagtctccaaggaactacagagccttccatgactcactcaataatcgctagcacctcgctgtagttgtacattgaaccctggcatcttcgtctttggaactaagtctcctgagcattgtttttaaatagaaataaaatctggctttaaaagagaagactaaatggaaaaagaatctagaaaaagagaatcttgaatacaagttcctgataacttcaaagatcataccactggacataagaactttcgaaagaatttgtacgtgaacaggctgataccattcatgaaaattcgtaggagagagagaagaaaaaaagtccatgtagtgggactagataatcaaaagcataatgttggtcataattttctattgtgaaaatgtgctgattctttgaatggtgggattactccagatttatgaactttttttcttgagcaatgggtaaagtatagcttgtgtaaacaaaggattgaaacatttgcttttgatctctatctg

SEQ ID NO: 28877 - DNA, 1245 bp, Homo sapiens
gtgattcttctgctcagtgagtgctgggaaacagtgctaagaaggatacagtggctagaagtcgtcctgtcgtcctgcctcacagtaacatcgttaccgaattctcagcaggtgaaccaaatgaaatggtcaactgaaagccaaccaggtctctccttgtgagaagtgaatttcttcaacgtttatagaactgaggtattacattattggatgaattaagaaaacaatctaacctgatgtgtgaaaatttctgcttgtgagaatccgtgttatttcaattatccaatcaagagcctaattcgtataaaagaaacacagcagcttgttgctcatctttttatctaaggacggtttgtcttgacagagggtgtctggctgttttggggaaactattcctgaccttattttgactaaaaagttgcctgctgtaccagcaaaaaatcaccatgtaccaacctatccaaacttatccatggatgaatctatccagaagacgggagttccgatgcttgtcttgctctgaatgtctgcttgtcacctgcttagggttatcgactgtgattctgggactcattgttgttctacaggacccctctgactctgtggttttctctactggattaacaatgatagccataggtgctttttttgttgtcctcactggagtgacagccctgtgtacggttacagtcgacgagaacttgcagaaaaccacgaggctaagactaggagtgatacgaaaaagcggaagtctccaaggaactacagagccttccatgactcactcaataatcgctagcacctcgctgtagttgtacattgaaccctggcatcttcgtctttggaactaagtctcctgagcattgtttttaaatagaaataaaatctggctttaaaagagaagactaaatggaaaaagaatctagaaaaagagaatcttgaatacaagttcctgataacttcaaagatcataccactggacataagaactttcgaaagaatttgtacgtgaacaggctgataccattcatgaaaattcgtaggagagagagaagaaaaaaagtccatgtagtgggactagataatcaaaagcataatgttggtcataattttctattgtgaaaatgtgctgattctttgaatggtgggattactccagatttatgaactttttttcttgagcaatgggtaaagtatagcttgtgtaaacaaaggattgaaacatttgcttttgatctctatctg

SEQ ID NO: 28878 - DNA, 606 bp, Homo sapiens
agtgaggaggagtggtgtactttcaagacaggcttggtctcctgtttggtaacctcgagggtgggattttagtcactctgcccttcttaattagaaagaagcagtctcacaacagtggtttctctttcttgaatacacaaaagcatattcccattagatctaccactaattgctttttatgcagtctgatttcaaaataattgtcttacttaactgtgggaatatcaaggagaggaagaaagatcaagcacttaagatgcttcatatggcagaaagacgccaggagtcatcataagtattattagaaaggctaatccctgagtcacttttaacacccctgaactctttaacctgcatacctgggatgagcaagagaggctagtgcgcacccaccttatcgtatattctctactattgtattatagtcaacctagttttttggaaaagaaaccgataataaaatttgaagcctcatgagccatatatatacagtctctgttgcatactattatttgattttctttaatgaacttttgaacatattttttaaagattctcatcttaaccctgtaagaacaggccatgacccggatttagcttgagggg

SEQ ID NO: 28879 - DNA, 701 bp, Homo sapiens
gcggccgcaagctcggcactcacggctctgagggctccgacggcactgacggccatggcgcgttcgaacctcccgctggcgctgggcctggccctggtcgcattctgcctcctggcgctgccacgcgacgcccgggcccggccgcaggagcgcatggtcggagaactccgggacctgtcgcccgacgacccgcaggtgcagaaggcggcgcaggcggccgtggccagctacaacatgggcagcaacagcatctactacttccgagacacgcacatcatcaaggcgcagagccagctggtggccggcatcaagtacttcctgacgatggagatggggagcacagactgccgcaagaccagggtcactggagaccacgtcgacctcaccacttgccccctggcagcaggggcgcagcaggagaagctgcgctgtgactttgaggtccttgtggttccctggcagaactcctctcagctcctaaagcacaactgtgtgcagatgtgataagtccccgagggcgaaggccattgggtttggggccatggtggagggcacttcaggtccgtgggccgtatctgtcacaataaatggccagtgctgcttcttgcattggtttcttccaagtgcttcgcttctgcccccatcccccactcccacttctggcagctcccagctccccagcccaagctgagaggtcaccc

SEQ ID NO: 28880 - DNA, 609 bp, Homo sapiens
gcggccgcaagctcggcactcacggctctgagggctccgacggcactgacggccatggcgcgttcgaacctcccgctggcgctgggcctggccctggtcgcattctgcctcctggcgctgccacgcgacgcccgggcccggccgcaggagcgcatggtcggagaactccgggacctgtcgcccgacgacccgcaggtgcagaaggcggcgcaggcggccgtggccagctacaacatgggcagcaacagcatctactacttccgagacacgcacatcatcaaggcgcagagccagctggtggccggcatcaagtacttcctgacgatggagatggggagcacagactgccgcaagaccagggtcactggagaccacgtcgacctcaccacttgccccctggcagcaggggcgcagcaggagaagctgcgctgtgactttgaggtccttgtggttccctggcagaactcctctcagctcctaaagcacaactgtgtgcagatgtgataagtccccgagggcgaaggccattgggtttggggccatggtggagggcacttcaggtccgtgggccgtatctgtcacaataaatggccagtgctgcttcttgca

SEQ ID NO: 28881 - DNA, 371 bp, Homo sapiens
aaagaaaaaagaaaaaaagaaaaataaaagataggaccagggagttttcagaatcagaaataaaaattaccaactgatatatgaaaaaaatggctcaacattattttgtgagattcaaatttttagaagttgccaggcgtggaggcttatgccaataatcccagcactttagtaggctgaagtgggtgaatcacttgaggccaggagttcgagaccagcctggccaacctggtgaaaccctgtgtttactaaaaatacaaaaattagccaggcgtggtggtgggcgcctgtaatcccaggtactcgggaggctgaggcaggagaatcatttgaacccgggaggcggaggttgcagtgaactgagatcgagc

SEQ ID NO: 28882 - DNA, 422 bp, Homo sapiens
attacaaatacaaatactctcctaaaaatacaaaaattatccaggcgtggtggtgggcacctgtcctcccgaatcactgggactaccggctaccaagcctggctaaaaaagtttttaaactttggttgtgatttaaaacaagtacatgcagctggccgtggtggctcacacctgtaatcctagcactttgggaggcctaggagagtggattgcctgaggtcggaagttcaagaccagcctggccaacatggtgaaaccttgtctctactaaaaatacaaaaaattagccgagtgcagtggcgtgtgcctgtaatcccagctactctggagactgaggcaagaaccctggatgtggaggttgtggtgagccaagatcacgcctctgcactccagcctgggctacagagcgagacttggtctca

SEQ ID NO: 28883 - DNA, 321 bp, Homo sapiens
aaaaacatacaaagaagaagtgcctaaagaattacaacagaaagtggcatagtgattattagagttaatataatataaataaggccaggcatggtggctcatgcctataatcccagcacttttggaggtcaagttgcagggatcacttgaggacaggggatagagacaagcctagccaacatggtgaaacccatctctactaaaaatacagaaattagctgggtgtggtgatgggcgctggtaatcccagctactcaagaaactgaagcaggagaattgcttgaacccggaagctggggctgcagtgagccaagatcgcgc

SEQ ID NO: 28884 - DNA, 324 bp, Homo sapiens
gtacatattttgctgttctatttaatcaccttgaaaagattaattcattactctttgattaattgatatttatttattccttcacatacactcttaatatttacagaaattttaatcttgtcaaatctttctcaagactttctattaagtgctacagagactagagagtgtgcaaaagtgtaataactatcaaggaattcatggcctagtgatgtgtctaaatagcttgcattagatatcctcaaattagcagtacagcagtgaaaaaaggaatttccagttgtcgttttaggcttgggtaatttggatgcagatagtactaga

SEQ ID NO: 28885 - DNA, 237 bp, Homo sapiens
agcccaggaggttgaggctgcagtgagccatgactgcgccactgtactccaagaatctaacaaacaaacaaaaaccccaaaagagccaaataaaaataaaaaaggaagtgctgctagttttcaagtctgacataaaaatctaccatacaagtgtctttaaaaggaattatttctaaaaatgcatcatttaatggttctcctagctcaaaactattgaataagtatttattgtgttcc

SEQ ID NO: 28886 - DNA, 890 bp, Homo sapiens
gtgctgggattacaggcatgagccactgtgcccagccgtgtgctgatttctaagggcctctctcaagaagctcgtgttgataaaaaggtaatttcaggtgctcacttgagagctgtgaattaaaaacagggaaaagatggcgggtgagggcagcaggcgaggactgttttgtttgcagggggccagggtaggtcactctgctgcggtgaccttgcggctgagccctgaacaatgagcagccgcagccaacatgcagggatcctgcttgggggctggaactggaatgttgaatgtttcaggaacaggagggaggacagaatggggcttggagagcttggtggcaccagttcacccacagcctctgggctctagtgaggaaatgagaccccagcagagaccagggggtcagttaatgttcggatcaacatcattatgtggtcccttagctctgagtgaagggcggattgggaggcgggcaaggaggccaggacaacatacaggtgacataggatggcggcatgggcctgggtgctgtgcttagagccagaagtgggcaggtcgcgagatacttgagaggcagagcccacaggacttgctgatggcttctgtgagggggatgacagggaaggtgaggaatcaaggcagagtctcagctttgggatctgagattcattcaacaaataattcagtgccgcgtgccaggcctattctaaaagttgaggatatgaagacaacaatggtgatggcctcaagcagtaatcccagcactttgggatgctgaggcaggagaatcgcttgaacccgggaggcgcaggttgtagggagacgaaatcgcgccactggcactccagcctgggcgacagagggaggctccgtctcaaaaaaaaaaa

SEQ ID NO: 28887 - DNA, 380 bp, Homo sapiens
gagatgggacaggctgggatgacagctggatgtgacagagcaggggttcccatgctggagggcccgcctcagagaatgtgtgtttctggccagcacagtggctcacgcctgtaatcccagcactttgggaagccgaggcaggcggatcacgaggtcaggagatcgagaccagcctggccaacatggtgaaaccctgtctctaataaaaacacaaaaaaattagccaggcgtggtggcgagcgcctgtaatcccagctactctggaggctgaggcaggagaatcgcttgaacccgggaggcgcaggttgtagggagacgaaatcgcgccactggcactccagcctgggcgacagagggaggctccgtctcaaaaaaaaaaa

SEQ ID NO: 28888 - DNA, 1439 bp, Homo sapiens
cttaacaataacaaagtcttgatgatgtacagtattcaaactttaggttgaaatacgttactctttgattcctagccagtagatcttatctacactttaatgggagagaatggtggtgtgtgggtaggcacaaatttatgtaaatagtgctccttctctttagtatgtttgctttgggggtagaaaaatggttttaacaaacactggtttccatcaaatgaatgatgtcttctccatcctgtggagacaagaatctgctagaaggatatgtgctaagttccttataagagataatggtgctctgcctatgccagcttggcacccgaagatgtgtgagtggacgtgaggctgagtattaccttagtatttttctctgggtctttggaaaaccatagtcaatttttagaacatattgctttcattccccataaactcttcacacatgataactgtttaagctttgaaaacacatactgaagtattgtgagcttaaaaaaactttttaaatatttgcatagttttgaggtgaatttgtttccttacagatctctcctaatcattgagatgtatatttcaaaagaggaaattttacatgttgtccaaaacagccttgctagtaactggtgaattttggtattaactattattaaagtctttaaacgacacaggtacctaaagatcaccttaatgtggcaatttgtgatggtgtagctagctgattgtgaaaactgttcctttaaagtcgcttcttgcatgttcggtgttagtcatccagctcaggcttgtgttgcagctgacaatctaggaaagacggccttagagagtggtgcaggccccacactgacggactgccttagaaacccgacttcctctagactttgaaccgccagacttttctcttgtttagaaaacaaacttatatttaatgtacttactacttaaaactccagacagagatataatgtagaaggcaaatattggccaattttttcctctttttaagtggaagacaaatgaacgggatttttaaagtgcttttaaagtgcatgaatggttaataaatcagtatgaattgtaagccttcatcttacatccaagtccttagttggttagggtttcttttctttcttttttaaagagtgtcaattaccttttgaacctgtgaaaatttgatagttgttaacagtctgatggtcctaattctttcttttcattctagaaatgaatgtggttgtaatcatgttcctaattcttgggacaacctctccttttccccattttttcgtgctgaagctcccaggtcaccccctggctgccagtgggagcctgcaggagtcggaagcctgagggacagcctcgcacatctccaccaagtacagctgcatcaccaagagcgcggggctgagctgatgcgctttttttcctctctgaaggatatg

SEQ ID NO: 28889 - DNA, 3191 bp, Homo sapiens
cttaacaataacaaagtcttgatgatgtacagtattcaaactttaggttgaaatacgttactctttgattcctagccagtagatcttatctacactttaatgggagagaatggtggtgtgtgggtaggcacaaatttatgtaaatagtgctccttctctttagtatgtttgctttgggggtagaaaaatggttttaacaaacactggtttccatcaaatgaatgatgtcttctccatcctgtggagacaagaatctgctagaaggatatgtgctaagttccttataagagataatggtgctctgcctatgccagcttggcacccgaagatgtgtgagtggacgtgaggctgagtattaccttagtatttttctctgggtctttggaaaaccatagtcaatttttagaacatattgctttcattccccataaactcttcacacatgataactgtttaagctttgaaaacacatactgaagtattgtgagcttaaaaaaactttttaaatatttgcatagttttgaggtgaatttgtttccttacagatctctcctaatcattgagatgtatatttcaaaagaggaaattttacatgttgtccaaaacagccttgctagtaactggtgaattttggtattaactattattaaagtctttaaacgacacaggtacctaaagatcaccttaatgtggcaatttgtgatggtgtagctagctgattgtgaaaactgttcctttaaagtcgcttcttgcatgttcggtgttagtcatccagctcaggcttgtgttgcagctgacaatctaggaaagacggccttagagagtggtgcaggccccacactgacggactgccttagaaacccgacttcctctagactttgaaccgccagacttttctcttgtttagaaaacaaacttatatttaatgtacttactacttaaaactccagacagagatataatgtagaaggcaaatattggccaattttttcctctttttaagtggaagacaaatgaacgggatttttaaagtgcttttaaagtgcatgaatggttaataaatcagtatgaattgtaagccttcatcttacatccaagtccttagttggttagggtttcttttctttcttttttaaagagtgtcaattaccttttgaacctgtgaaaatttgatagttgttaacagtctgatggtcctaattctttcttttcattctagaaatgaatgtggttgtaatcatgttcctaattcttgggacaacctgcaagacagtgagacagtttaaaaattacctttcatgttgaaaaagtctgaaacagagaacccaatgatatttaaaataaatgctacataaaactctttttaaaattttgattttaacttaattaaaacaatgtcataaatatgctttttgattttgttactgcttttaatattaaagtaatagaatattgaagcaatattgtctagcactctgctggacattaagtccgcgggaggagaagtgaacaggaatcgattctttgtcttttaactgcccttagttaggagatgttaaaatacttggcacctctggttatatgtatgttatgtgtgttctcccccctaaaatttctaagcacatttattcacttttaaaatgaatctttaaaagattatagttagtagttatagttaatattctatttacttggaaaaatgtgaataaatggatcttcaaaagattcattttaaaaatgaataaatgtataataggctataggtgatcttacttgcgtattaggtaggaggcacatatttataccatttcatatgtaatatctttgtcattgtgtttcatcgaagatcaattgctagcaacttgaagggtatttatacttgggtcacttgaactcagctgactaaattgtaagaacgagagcaagcaagatggctgttattggaagccataacttccagaagataattctgcacaattcgtaagttaaaaaaaatctgtagggtcttccactatcctttttcaggttgataatgctgttctgggcacacactttgtaaatggaatgttatggtacagtcgcctctcagtatccatggggcattggttccaggcctcccttaggatgccaaactccatggatactcaaaccccttctataaaatggtgtagtatttgcatatatcctagacacatcctcctgtatgctttaaatcatctctagattacttaaaatacctaatacaatgtaaatgctctgtaaatagttgttatactatattgtttagggaataatgacaaggaaaaaaaagcctgtacatgttcagcacaagtgaaaccatccttttttgcccccaaatattttcaatttgtatttggttgaatccatggatgcagaactcacggatacagagggccgactgtactttctttaaagtgttcaaaagtattactagcaaagaggaggaggagcaaagcatatatcagaagtaaaacaatttttcttgttgactgctttggtaaaaaacagtttgatggatagttttacatttcactggactagataaaaaatggtgctaatatttattgtagcttgatgctatagttgctttggtatcaaacttaatacctaacccatataagatccttattatataattttgtgatcagtaaaatgatattttaaagagtgatcttaaaaatatgacctggtcattgcacaacgtttgcatttgaaatgaatttttgtactatagggtggatatggagttattcagtgcaagtgtgtgcttaatatcaaaccctatgcaaggagctatgtctagatttttggtccaaatttgcctccttcaagcctactagtgtgagatggaaaaaaatcgattgctcttttaatattatttccattttgaaattctcgacacttgaatgaaggcagtagaggcctctttttggatttctcttctaataacaaaactttatttagggaaggtttccctgtgctatcgtaagtttgttttgagcactgcattcactttaaaattctggaggaacaaaggctgggcacataatcacaaagcccaggccacacaataattcggggttgtattttctaagaactatgtattgtttttagcttatagttaatattgtatttacttggaaaaatgtgaataaagttaattaacatta

SEQ ID NO: 28890 - DNA, 3538 bp, Homo sapiens
cttaacaataacaaagtcttgatgatgtacagtattcaaactttaggttgaaatacgttactctttgattcctagccagtagatcttatctacactttaatgggagagaatggtggtgtgtgggtaggcacaaatttatgtaaatagtgctccttctctttagtatgtttgctttgggggtagaaaaatggttttaacaaacactggtttccatcaaatgaatgatgtcttctccatcctgtggagacaagaatctgctagaaggatatgtgctaagttccttataagagataatggtgctctgcctatgccagcttggcacccgaagatgtgtgagtggacgtgaggctgagtattaccttagtatttttctctgggtctttggaaaaccatagtcaatttttagaacatattgctttcattccccataaactcttcacacatgataactgtttaagctttgaaaacacatactgaagtattgtgagcttaaaaaaactttttaaatatttgcatagttttgaggtgaatttgtttccttacagatctctcctaatcattgagatgtatatttcaaaagaggaaattttacatgttgtccaaaacagccttgctagtaactggtgaattttggtattaactattattaaagtctttaaacgacacaggtacctaaagatcaccttaatgtggcaatttgtgatggtgtagctagctgattgtgaaaactgttcctttaaagtcgcttcttgcatgttcggtgttagtcatccagctcaggcttgtgttgcagctgacaatctaggaaagacggccttagagagtggtgcaggccccacactgacggactgccttagaaacccgacttcctctagactttgaaccgccagacttttctcttgtttagaaaacaaacttatatttaatgtacttactacttaaaactccagacagagatataatgtagaaggcaaatattggccaattttttcctctttttaagtggaagacaaatgaacgggatttttaaagtgcttttaaagtgcatgaatggttaataaatcagtatgaattgtaagccttcatcttacatccaagtccttagttggttagggtttcttttctttcttttttaaagagtgtcaattaccttttgaacctgtgaaaatttgatagttgttaacagtctgatggtcctaattctttcttttcattctagaaatgaatgtggttgtaatcatgttcctaattcttgggacaacctgcaagacagtgagacagtttaaaaattacctttcatgttgaaaaagtctgaaacagagaacccaatgatatttaaaataaatgctacataaaactctttttaaaattttgattttaacttaattaaaacaatgtcataaatatgctttttgattttgttactgcttttaatattaaagtaatagaatattgaagcaatattgtctagcactctgctggacattaagtccgcgggaggagaagtgaacaggaatcgattctttgtcttttaactgcccttagttaggagatgttaaaatacttggcacctctggttatatgtatgttatgtgtgttctcccccctaaaatttctaagcacatttattcacttttaaaatgaatctttaaaagattatagttagtagttatagttaatattctatttacttggaaaaatgtgaataaatggatcttcaaaagattcattttaaaaatgaataaatgtataataggctataggtgatcttacttgcgtattaggtaggaggcacatatttataccatttcatatgtaatatctttgtcattgtgtttcatcgaagatcaattgctagcaacttgaagggtatttatacttgggtcacttgaactcagctgactaaattgtaagaacgagagcaagcaagatggctgttattggaagccataacttccagaagataattctgcacaattcgtaagttaaaaaaaatctgtagggtcttccactatcctttttcaggttgataatgctgttctgggcacacactttgtaaatggaatgttatggtacagtcgcctctcagtatccatggggcattggttccaggcctcccttaggatgccaaactccatggatactcaaaccccttctataaaatggtgtagtatttgcatatatcctagacacatcctcctgtatgctttaaatcatctctagattacttaaaatacctaatacaatgtaaatgctctgtaaatagttgttatactatattgtttagggaataatgacaaggaaaaaaaagcctgtacatgttcagcacaagtgaaaccatccttttttgcccccaaatattttcaatttgtatttggttgaatccatggatgcagaactcacggatacagagggccgactgtactttctttaaagtgttcaaaagtattactagcaaagaggaggaggagcaaagcatatatcagaagtaaaacaatttttcttgttgactgctttggtaaaaaacagtttgatggatagttttacatttcactggactagataaaaaatggtgctaatatttattgtagcttgatgctatagttgctttggtatcaaacttaatacctaacccatataagatccttattatataattttgtgatcagtaaaatgatattttaaagagtgatcttaaaaatatgacctggtcattgcacaacgtttgcatttgaaatgaatttttgtactatagggtggatatggagttattcagtgcaagtgtgtgcttaatatcaaaccctatgcaaggagctatgtctagatttttggtccaaatttgcctccttcaagcctactagtgtgagatggaaaaaaatcgattgctcttttaatattatttccattttgaaattctcgacacttgaatgaaggcagtagaggcctctttttggatttctcttctaataacaaaactttatttagggaaggtttccctgtgctatcgtaagtttgttttgagcactgcattcactttaaaattctggaggaacaaaggctgggcacataatcacaaagcccaggccacacaataattcggggttgtattttctaagaactatgtattgtttttagcttatagttaatattgtatttacttggaaaaatgtgaataaagttaattaacattaaaaaaaaaaaccgacaacaacactcatacaaagccacaacattgttgtggggcaacgcatctgggcccccgcaaaaaacggttgttctcaaaacacccatccggatagggcgagccggcggcacccccgaggacggttagaggagaccacggggtccacaacggtgtccaccagaggacaacatccgggggccgacaaacaagggcggggggatcacccacgccagtagaaaaagaccccggggggacaaacgaatcgtggtgaaaacaccacccgaggggagatatcgagagcacaaacgcggacatacgacggagggtcacagcgggcgcccgaataaagtagcc

SEQ ID NO: 28891 - DNA, 3137 bp, Homo sapiens
cttaacaataacaaagtcttgatgatgtacagtattcaaactttaggttgaaatacgttactctttgattcctagccagtagatcttatctacactttaatgggagagaatggtggtgtgtgggtaggcacaaatttatgtaaatagtgctccttctctttagtatgtttgctttgggggtagaaaaatggttttaacaaacactggtttccatcaaatgaatgatgtcttctccatcctgtggagacaagaatctgctagaaggatatgtgctaagttccttataagagataatggtgctctgcctatgccagcttggcacccgaagatgtgtgagtggacgtgaggctgagtattaccttagtatttttctctgggtctttggaaaaccatagtcaatttttagaacatattgctttcattccccataaactcttcacacatgataactgtttaagctttgaaaacacatactgaagtattgtgagcttaaaaaaactttttaaatatttgcatagttttgaggtgaatttgtttccttacagatctctcctaatcattgagatgtatatttcaaaagaggaaattttacatgttgtccaaaacagccttgctagtaactggtgaattttggtattaactattattaaagtctttaaacgacacaggtacctaaagatcaccttaatgtggcaatttgtgatggtgtagctagctgattgtgaaaactgttcctttaaagtcgcttcttgcatgttcggtgttagtcatccagctcaggcttgtgttgcagctgacaatctaggaaagacggccttagagagtggtgcaggccccacactgacggactgccttagaaacccgacttcctctagactttgaaccgccagacttttctcttgtttagaaaacaaacttatatttaatgtacttactacttaaaactccagacagagatataatgtagaaggcaaatattggccaattttttcctctttttaagtggaagacaaatgaacgggatttttaaagtgcttttaaagtgcatgaatggttaataaatcagtatgaattgtaagccttcatcttacatccaagtccttagttggttagggtttcttttctttcttttttaaagagtgtcaattaccttttgaacctgtgaaaatttgatagttgttaacagtctgatggtcctaattctttcttttcattctagaaatgaatgtggttgtaatcatgttcctaattcttgggacaacctgcaagacagtgagacagtttaaaaattacctttcatgttgaaaaagtctgaaacagagaacccaatgatatttaaaataaatgctacataaaactctttttaaaattttgattttaacttaattaaaacaatgtcataaatatgctttttgattttgttactgcttttaatattaaagtaatagaatattgaagcaatattgtctagcactctgctggacattaagtccgcgggaggagaagtgaacaggaatcgattctttgtcttttaactgcccttagttaggagatgttaaaatacttggcacctctggttatatgtatgttatgtgtgttctcccccctaaaatttctaagcacatttattcacttttaaaatgaatctttaaaagattatagttagtagttatagttaatattctatttacttggaaaaatgtgaataaatggatcttcaaaagattcattttaaaaatgaataaatgtataataggctataggtgatcttacttgcgtattaggtaggaggcacatatttataccatttcatatgtaatatctttgtcattgtgtttcatcgaagatcaattgctagcaacttgaagggtatttatacttgggtcacttgaactcagctgactaaattgtaagaacgagagcaagcaagatggctgttattggaagccataacttccagaagataattctgcacaattcgtaagttaaaacacacactttgtaaatggaatgttatggtacagtcgcctctcagtatccatggggcattggttccaggcctcccttaggatgccaaactccatggatactcaaaccccttctataaaatggtgtagtatttgcatatatcctagacacatcctcctgtatgctttaaatcatctctagattacttaaaatacctaatacaatgtaaatgctctgtaaatagttgttatactatattgtttagggaataatgacaaggaaaaaaaagcctgtacatgttcagcacaagtgaaaccatccttttttgcccccaaatattttcaatttgtatttggttgaatccatggatgcagaactcacggatacagagggccgactgtactttctttaaagtgttcaaaagtattactagcaaagaggaggaggagcaaagcatatatcagaagtaaaacaatttttcttgttgactgctttggtaaaaaacagtttgatggatagttttacatttcactggactagataaaaaatggtgctaatatttattgtagcttgatgctatagttgctttggtatcaaacttaatacctaacccatataagatccttattatataattttgtgatcagtaaaatgatattttaaagagtgatcttaaaaatatgacctggtcattgcacaacgtttgcatttgaaatgaatttttgtactatagggtggatatggagttattcagtgcaagtgtgtgcttaatatcaaaccctatgcaaggagctatgtctagatttttggtccaaatttgcctccttcaagcctactagtgtgagatggaaaaaaatcgattgctcttttaatattatttccattttgaaattctcgacacttgaatgaaggcagtagaggcctctttttggatttctcttctaataacaaaactttatttagggaaggtttccctgtgctatcgtaagtttgttttgagcactgcattcactttaaaattctggaggaacaaaggctgggcacataatcacaaagcccaggccacacaataattcggggttgtattttctaagaactatgtattgtttttagcttatagttaatattgtatttacttggaaaaatgtgaataaagttaattaacatta

SEQ ID NO: 28892 - DNA, 415 bp, Homo sapiens
tgggaggcagaggttgcggtgagccaagatcgctccacagcactccagcctgagtgacaagggagactgcgtctcaaaaacaaaaacaaaaacacctaagatttcaaaaaaggagggagcgcctgtctaattctggtagctggtttgctgttgttctccaagcattcctatggggcttttgttgcttcatggttcatattaaccaagcccaaattccagaacattccatcctcctggaaagccttccattcctgactacgcattcagagcaggtaggctgtgggcacttggttaaggtcaatgcctgccattcccccatgaggccctgtgtgaacaggactgggaagatgaggataagaagggccccagggagctcagcccgggcattcatgcgtcatctctgctgtctgcttcc

SEQ ID NO: 28893 - DNA, 409 bp, Homo sapiens
ataaaacaaggcacatctctacctgaaattgtaactgctggactagaacaaagtaatctgagcagcttgaatgtaccttgtaaaagggcttttgtttcatttagaaaataacttgagccctgggaaaatctggatcaagttgagagagagaaagaaagaagaagtggaagagagaagagagagagaatgagttgagagtgaattttagagtaaaacatagcacattgtatgacctccaggctataatagagtgtatataaagcatatatataaagcatatataaaagcccctgaaggcttatgagaggtaaactgcaaagcattgactaaatatatcatttggccaattttcccatgacaatttagtttggtgccctttgactgggacgttctgttttttttttccctt

SEQ ID NO: 28894 - DNA, 869 bp, Homo sapiens
cgcccggctaatatttgtatttttagtagagaggccatgttggccaggatggtctcaaactcctggcctcaagcgatctgcctgcctcagccccctaaattgctgggatttcaggcatgagccaccatgcccagcctagcatttttgactgggcaagtgagctgccttctcctagcctccgtttcctcatttgtcaaatggggctggtaactccacccacttcacagggggtggtgagaatgaatggttacaggcatgtaatgtaattgaggcagctctcagcaggaagtaagcagtcagacaacacgtcacttattcaatagcctcttggatctttggtttcttttttttgtaagacggggacccaaacctctttgtccctggattgtagacaactgggtggcatgagagttattaaaaatcacagtgccccagccggacggggcggctcacgtgtgtaatcccagcaatttgggagtctgaagcaggagggtggcttcaccctagggtttgaggctgcagtgagctatgaccgcaccactgcactccagcctgggccacagagcaaggcccagtctcaaaagagaaaaaggaggccaggcacagtggctcatgcctttaatcttgacactttgggaggccgaggcaggcagatcaggaggtcaggagatcaagaccatcctggcctacgtggtgaaaccctgtctctactaaaatacaaaaagttagctgggcatggtggcgcacgcttgtagtcccagctactcggggggctgaggcaggagaattgcttgaaccccagaggcgagattgtgccaccgcactccagcctggcgatagggcaagactccgtctcaaaacaaaaagaa

SEQ ID NO: 28895 - DNA, 329 bp, Homo sapiens
ggagagaaagagggaaagaaactccctacctccttcctgagtcgacattctgtacctcttggtactgcatttctcaggcaccctagtgcccttggaccagattcccagcttccatggcctcagggaacatggaatactaatcatccttttcctttgtcctggatagttgtaataaggaatcagcaagagaaactgaaaatctaaattctccttcagatctaactattaaaaaatatgaagcaattaataaagtatgtatgtagacatgtaaatagaataataatattttaaatgtaacctaaatgtttgaaggaacttttaaatagatt

SEQ ID NO: 28896 - DNA, 476 bp, Homo sapiens
ttttttaaatggagtctcactctgtcccccaggctggagtgcagtggcgcgatctcggctcactgcaacctccgcctcccaggttcacgccattctcccacctcagcgtcccaagtagctgggactacagatgcccgccaccacgcttggctaattttttgtatttttagtagagacagggtttcaccgtgttagccaggatggactcagtctcctgacctcctgatccgcccgcctcggcctcccaaagtgctgggattacaggcctgagccgccacgcctggcctattgctttatttattaagctacaacatttgatgagcacatttgatgaaataaaaagttcttgttgttggctcctgcagttgtgtcaatctttaaaatttacaaaagaacttaaaaacctaacagggagtaattctatcttccttgagctacaatttgcagagtttttaaagaagccacgttgagaagac

SEQ ID NO: 28897 - DNA, 561 bp, Homo sapiens
gtttccacagacacacgtaccacatgggatttttaagtagacatccaggaagagaacgaaagttcccctgttggttttcccctatttttaagtgtgagtgtatgaatgtgtgttttgttctcttccttttatattgcctcctggatttgggttgttttcctttatctgtccggactgtaaatgtggatatgaaggttcatagtcctgtagaataacgtcagtgcttgagctagtgtttggtgtgaagtacctatcttttgaagggagagaaaagaattacgactgtggtaagatttaagaggacagaattaagattatgtaagggttgaagaaaggtttgctgggaatgtggtgtgtgttttagcagagaccccaatgacctgccagggcacgtagagagagcaggctacttgagggcagggagtagaccaccgccatttctgtgacctcacatctggcatggccaggcacacagtaggtactcaataattaactccctgctgtttccctaatcatgtagaggaaagcaacaatgttcagtaattaactgtttaaaaaaaa

SEQ ID NO: 28898 - DNA, 500 bp, Homo sapiens
atgtatcaacaatatgtcttgtcaagatattattttgtaacattttcagaatgaaacccatctctgggcactggggttcattcttggtgcacaactgcctcgttgatcaagttctctggcttttattatttctgcttgcaaatagagatacaaaacagccagcctcagaagaaggaggggctgatttcatcagcatgactaaagctgacagagtacttgagaggacctggcagggtactgcagaacatcttggccttgcagatctgtgagaaaggtttgctgggaatgtggtgtgtgttttagcagagaccccaatgacctgccagggcacgtagagagagcaggctacttgagggcagggagtagaccaccgccatttctgtgacctcacatctggcatggccaggcacacagtaggtactcaataattaactccctgctgtttccctaatcatgtagaggaaagcaacaatgttcagtaattaactgtttaaaaaaaa

SEQ ID NO: 28899 - DNA, 413 bp, Homo sapiens
tttttttttttgagtcagagtctcactctgttgcccaggctggagtgcggtggcataatctcagctcactgcaaactccgcctcccaggttcaagtgattctcctgcctcaggctcccaagcagccgggaccacaggcgtccgccaccacacctggctgatttttgtattttcagcagagacagggtttccaccatgctggccaggctagcctcaaactcctgacctcaggtggtccgcctgcctcagcctttcaaagtgccggaattacaggggtgagccacagcacctggccacaaatagcaacttttaatggcacatgcccacagatcattgacttcgataggatatctggtatacaagagcaagtcattaaaaccaggaataatagagattttttgcaaaaggtcgacg

SEQ ID NO: 28900 - DNA, 411 bp, Homo sapiens
gaaatctggcttctggcccaggaactatgtcctacagaggtagagataaaaaaaaactgctgcaaagaagtgactaattcataaaattcatcactcgctaatttttgaaaagctttcaaagactttctactcactccaagagcagaatgactaaatcaataaagagcaagtagcctccttttctgactgattttaacagcaatgatgtttcttggctacatttgtaaaaataaaagatgaagtttttaatattactataaagctaatctaaaactcactggcttttggctctaaaatgaaaatatacaaagtcactaccccatgcctattgctgattcaattaattcagttgcctgtgttccaaataggtgagggtaaacagcagattatcttagctcactgataatctgc

SEQ ID NO: 28901 - DNA, 382 bp, Homo sapiens
aaaatcctgtattgctaaaaaacactaatgatcatctgagccttcagcaagtcctaatctttttgctagtggaaggtcttgccttgatgttgatgcttgctaactgatcagggtggtggttgctgaaggttgggatagctgtggcagttccttaaaataagacaacagtgaagtttgttacatcaattgactcttcttttcacgaaaacatttctctgtagcatgcagtggtgtttgagaacatattgcccgtcgtagaacctctttcagaattggagtggggtcgggcatggtgtctcatgcctgtcactttggaaggataaggtgggaggcttgcatgaggccaggagtttgagaccagccttggcaacataccaagacc

SEQ ID NO: 28902 - DNA, 5155 bp, Homo sapiens
  misc_feature (2166)..(2166): n is a, c, g, or t
  misc_feature (2169)..(2169): n is a, c, g, or t
  misc_feature (2786)..(2786): n is a, c, g, or t
cgcttccgccggtgggacggaactggtgccctccgtggacaattgtgttgaagcagaaattgttccggatctcgggtcggacacggaagtcttcctgcagtgtttctggatgcggggacagggatgcgcaggaattccagtctcagtttccagatggagcgacccctcgaggagcaagtccagagcaagtggtcgtctagtcaaggccgcacaggaacaggagggtctgatgtcctccagatgcagaacagtgaacaccatggacaaagcatcaagactcaaactgactccatctcccttgaggatgtggctgtgaacttcaccctggaggagtgggctttgctggatcctggccagaggaatatctacagagatgtgatgcgggcaaccttcaagaacctggcctgtataggggaaaaatggaaagaccaggatattgaagatgaacacaaaaaccagggaagaaatctaagaagtcctatggttgaagcactctgtgaaaataaagaagattgtccatgtggaaaaagcactagccagattcctgatcttaatacgaacctggaaactcctactggattaaaaccatgtgactgcagtgtgtgtggggaagtcttcatgcatcaggtctcccttaataggcacatgagatctcacactgaacagaaaccaaatgagtgtcacgaatatggagagaagccacataaatgcaaagaatgtgggaaaaccttcactcgcagctccagtattcgaacccatgaaagaattcacactggagagaaaccctatgaatgtaaggaatgtggcaaagccttcgcatttctcttttcctttcgaaaccatataagaattcatactggagagacaccctatgaatgtaaggaatgtgggaaggcattcagatatctcactgctcttcggcgccatgaaaaaaatcacactggagagaaaccctacaaatgtaaacagtgtggaaaagcctttatatattaccagccttttctaacccacgaaaggactcacactggagagaaaccttatgaatgtaagcaatgtgggaaagccttcagttgtcccacgtacttacggagtcatgagaaaactcatactggagagaaaccttttgtatgtagggaatgtgggagagccttcttttctcactcaagccttcgaaaacacgtgaaaacccacaccggagttcaaccttatacatgtaagaaatgtggggaagccttcaagtcatctagttcctgtgaagtgcacgaaagaactcattttggagaaaaaccctatgaatgtaaacaatgtggtaaagccttcaattcttcaagttaccttcagttgcacgaaagagttcacactggcgagaaaacttacgaatgtaaagaatgtggtaaagcctttctttattccactcactttcgaatccatgaaagaacccatactagagagaaaccctatgaatgcaaacagtgtggtcgggtcttcatttacttcagtcaccttcgaaggcacgaaagaagtcacactggagtgaaaccatgtgagtgtaagcagtgtggcaaagctttcacttgtttaaattccctgaaagtacacaaaagaattcatactggagaaagaccctttcagtgtagacaatgtggtaaagccttcagttactcaaagtctttgcacgtgcacgaaaggactcatagtagacagaagccctaagaaagtaaagtgtggtaatgctgtcagttgtattagttccttttggatgtatgagagtacttacgctggagagaaattcaaggaatgtaaacggtgtgattaagccttcagttgtcctaattccctttgaagacgtgactcatgcggcaatgaaatatttaacaaatgggggaggaacttgcactctcctgcgggattgcagatatgtgaatggactccatggacagaaaagctacgaatgtatggagtgtaggaaagccttcacttcacgtaatcttttaaagacacctgagaatatatactggagagaaactataaagaaaattctatatccatcccatcttttgtggggtttgttttttgtttttgtttttgttgagatgtaattttgctcttgttgcccaggctggagtgcagtggtgcgatcgcggctcaccgcaacctccgcctccnggnttcaagcaattctcctgccgcagcctcccaagaagctgggattacaggcatgcgccaccacgcctggctaattttgtaattttagtagagatggggtttctccatgttggtcaggctggtctcaaactcctgacctcaggtgatctgcctgcctcggcctcccaaagtgctgggattacaggtgtgagccacagcacccaacctttttttccccgccgcaccccaagatggtgtctcactctgttgccccaggctggagtgcagtggtgtgatcctggctcactgtaacctctgggttcaagcaattcttctgcctcagccttccaagtagctgggattacaagtgcccaccaccatgcccagctaatttttatatttttagtagagacagtgtttcaccatgttgaccaggctgatcttaaactcttgacctcaaatgatccacccaccttggcctcccaaattgttcgttttacttttttttttttttttttttgagctggagtcttactctgttgcctaggctggagtgaaagtggcgcaacctctgcctcccaggtcaaagcaatcctgcctcaggccccctagtagctggcattacaggcacatgccaccangcccaactaatttttatatttttagtagagacggggtttcaccatgttggccaggctggtcttgaactcctgacctcaggtaatccacctgccttggcctcccaaagtgctgggattacaggcgtgagccaccacacccggcccccagttctttttttttttttttgagacggagtccttgcccaggctggagtgcagtggcgcgatctcagctcactgcaagctccgcctcctgggttcacgccattctcctgcctcagcctcccgagtagctgggactacaggcgcccgccaccacgcccggctcattttttgtatttttagtggagacggggtttcaccgtgttagccaggatagtcttgatctcctgacctcgtgatccgccctcctcggcctcccaaagtgctgggattataggcgtgagccaccgcgcccggcctccagttcattttaaaaccatgaaaccacccacactggagagccgccttcttaaatgtaagcaatatgggaacatcttcaatgacatctgcaaccattgtcgagattcttcgtaggaagaattaaaggaatggggaagaaggacttgggccccagcaggccttttgtggcatccagtcagaagttaggaaacaccctctagggcagtgcctgccctcagctctcacacatgactggagagaagtgagaagactcccagaatctgccttttaagtttccatcagtgtcctcgggtcagactgtgggaatgctgtacttctaagacaaaggttcgcatcttacagtttttccccaagtgggatctgcctatgcacatcctaattcacagacattgtcagcattgcattattccagggctgttttgaggtcatctccagctccatttcccatctcaaacctacactttggacacttgtttaaacattcacatctgaatttctctgtggcaaccgcaggtggctctgaggtgagagactgaagaagcagagcctgtatcatgggacacacaccccttgaccacacagcatccactctcctgcggttaccagccctgcaccaaccaccacagtcagaataatctcaaaactgctagtggagtcacagacacactctgccatgtcttagctgtaggacactcagaattcttacctcccctaacttgctttccctgttttctggcacattctaccctgagatattcagcggcatatgcactgatgatgctccggccttctcacgtcagtgcatgtcacatgcatcctgctccaggactggtttcctagcctcccgctaagactagcacttagctcttcttggaaaaggacccaccctgcagcgctccagctctgttgtgtatgggaggtgctggtgtcagggttcacaagccatggaactaccttgcttcacatcacaaggcaaggtgaactcaactcccaataaactgcttgctggagcctccgaattctccgttttctgaattgcataggcacgataggggtcgggtctgtcctttgttggagtcagtccccccttttcttagcaagtcagtgtgttttagaagggaggtggcagcattgagggaaaccaggtcaccatccaccctcgtaacaacagtctccctgggtgggtcccagaagtgatctttgtgtcgctcgggtcggaactctttaggcctctggcctccaccctcccccaacagcagggatgggtcaggtggcagcatccaaaaccacggtgaagatactagggtccagaggccgactggagcaaggtttgctggcagatgaggcctcagtggaagtgacggctactgtggagatgcagtggaggacctggtggctgagccaggagatgcacacattcgcttctctcaccaggaacatttatggtagtatgaggggttggaacattattactcaacccatttcaggtcctttcacattcttgagctgccatgttgtgcttttgtagagagatgattattgtactgtgggaggtcaggaagtctctttaagaaaatagtttaaacaatttgttaaaaaattttccgtcttatttcatttctgtaacagttgatatctggctgtcctttttataaatgcagagtgagaactttccccttaccgtggtttgattacactgttgttccagggttctattgccaagaatgtgtttgtcccaaaaatgcctgtttagtttttaaaagatgggaactccaccctttgctttgggtttcacgtattgtcttggacggcgctgactcaggacctcgatgtacggcgggccgacctggaccggtggggcgcaccaccttcctgtgctaacccttttttacgtcccaacacaaaacaccaacaacaaccccccaaag

SEQ ID NO: 28903 - DNA, 6193 bp, Homo sapiens
  misc_feature (2166)..(2166): n is a, c, g, or t
  misc_feature (2169)..(2169): n is a, c, g, or t
  misc_feature (2786)..(2786): n is a, c, g, or t
  misc_feature (5654)..(5654): n is a, c, g, or t
cgcttccgccggtgggacggaactggtgccctccgtggacaattgtgttgaagcagaaattgttccggatctcgggtcggacacggaagtcttcctgcagtgtttctggatgcggggacagggatgcgcaggaattccagtctcagtttccagatggagcgacccctcgaggagcaagtccagagcaagtggtcgtctagtcaaggccgcacaggaacaggagggtctgatgtcctccagatgcagaacagtgaacaccatggacaaagcatcaagactcaaactgactccatctcccttgaggatgtggctgtgaacttcaccctggaggagtgggctttgctggatcctggccagaggaatatctacagagatgtgatgcgggcaaccttcaagaacctggcctgtataggggaaaaatggaaagaccaggatattgaagatgaacacaaaaaccagggaagaaatctaagaagtcctatggttgaagcactctgtgaaaataaagaagattgtccatgtggaaaaagcactagccagattcctgatcttaatacgaacctggaaactcctactggattaaaaccatgtgactgcagtgtgtgtggggaagtcttcatgcatcaggtctcccttaataggcacatgagatctcacactgaacagaaaccaaatgagtgtcacgaatatggagagaagccacataaatgcaaagaatgtgggaaaaccttcactcgcagctccagtattcgaacccatgaaagaattcacactggagagaaaccctatgaatgtaaggaatgtggcaaagccttcgcatttctcttttcctttcgaaaccatataagaattcatactggagagacaccctatgaatgtaaggaatgtgggaaggcattcagatatctcactgctcttcggcgccatgaaaaaaatcacactggagagaaaccctacaaatgtaaacagtgtggaaaagcctttatatattaccagccttttctaacccacgaaaggactcacactggagagaaaccttatgaatgtaagcaatgtgggaaagccttcagttgtcccacgtacttacggagtcatgagaaaactcatactggagagaaaccttttgtatgtagggaatgtgggagagccttcttttctcactcaagccttcgaaaacacgtgaaaacccacaccggagttcaaccttatacatgtaagaaatgtggggaagccttcaagtcatctagttcctgtgaagtgcacgaaagaactcattttggagaaaaaccctatgaatgtaaacaatgtggtaaagccttcaattcttcaagttaccttcagttgcacgaaagagttcacactggcgagaaaacttacgaatgtaaagaatgtggtaaagcctttctttattccactcactttcgaatccatgaaagaacccatactagagagaaaccctatgaatgcaaacagtgtggtcgggtcttcatttacttcagtcaccttcgaaggcacgaaagaagtcacactggagtgaaaccatgtgagtgtaagcagtgtggcaaagctttcacttgtttaaattccctgaaagtacacaaaagaattcatactggagaaagaccctttcagtgtagacaatgtggtaaagccttcagttactcaaagtctttgcacgtgcacgaaaggactcatagtagacagaagccctaagaaagtaaagtgtggtaatgctgtcagttgtattagttccttttggatgtatgagagtacttacgctggagagaaattcaaggaatgtaaacggtgtgattaagccttcagttgtcctaattccctttgaagacgtgactcatgcggcaatgaaatatttaacaaatgggggaggaacttgcactctcctgcgggattgcagatatgtgaatggactccatggacagaaaagctacgaatgtatggagtgtaggaaagccttcacttcacgtaatcttttaaagacacctgagaatatatactggagagaaactataaagaaaattctatatccatcccatcttttgtggggtttgttttttgtttttgtttttgttgagatgtaattttgctcttgttgcccaggctggagtgcagtggtgcgatcgcggctcaccgcaacctccgcctccnggnttcaagcaattctcctgccgcagcctcccaagaagctgggattacaggcatgcgccaccacgcctggctaattttgtaattttagtagagatggggtttctccatgttggtcaggctggtctcaaactcctgacctcaggtgatctgcctgcctcggcctcccaaagtgctgggattacaggtgtgagccacagcacccaacctttttttccccgccgcaccccaagatggtgtctcactctgttgccccaggctggagtgcagtggtgtgatcctggctcactgtaacctctgggttcaagcaattcttctgcctcagccttccaagtagctgggattacaagtgcccaccaccatgcccagctaatttttatatttttagtagagacagtgtttcaccatgttgaccaggctgatcttaaactcttgacctcaaatgatccacccaccttggcctcccaaattgttcgttttacttttttttttttttttttttgagctggagtcttactctgttgcctaggctggagtgaaagtggcgcaacctctgcctcccaggtcaaagcaatcctgcctcaggccccctagtagctggcattacaggcacatgccaccangcccaactaatttttatatttttagtagagacggggtttcaccatgttggccaggctggtcttgaactcctgacctcaggtaatccacctgccttggcctcccaaagtgctgggattacaggcgtgagccaccacacccggcccccagttctttttttttttttttgagacggagtccttgcccaggctggagtgcagtggcgcgatctcagctcactgcaagctccgcctcctgggttcacgccattctcctgcctcagcctcccgagtagctgggactacaggcgcccgccaccacgcccggctcattttttgtatttttagtggagacggggtttcaccgtgttagccaggatagtcttgatctcctgacctcgtgatccgccctcctcggcctcccaaagtgctgggattataggcgtgagccaccgcgcccggcctccagttcattttaaaaccatgaaaccacccacactggagagccgccttcttaaatgtaagcaatatgggaacatcttcaatgacatctgcaaccattgtcgagattcttcgtaggaagaattaaaggaatggggaagaaggacttgggccccagcaggccttttgtggcatccagtcagaagttaggaaacaccctctagggcagtgcctgccctcagctctcacacatgactggagagaagtgagaagactcccagaatctgccttttaagtttccatcagtgtcctcgggtcagactgtgggaatgctgtacttctaagacaaaggttcgcatcttacagtttttccccaagtgggatctgcctatgcacatcctaattcacagacattgtcagcattgcattattccagggctgttttgaggtcatctccagctccatttcccatctcaaacctacactttggacacttgtttaaacattcacatctgaatttctctgtggcaaccgcaggtggctctgaggtgagagactgaagaagcagagcctgtatcatgggacacacaccccttgaccacacagcatccactctcctgcggttaccagccctgcaccaaccaccacagtcagaataatctcaaaactgctagtggagtcacagacacactctgccatgtcttagctgtaggacactcagaattcttacctcccctaacttgctttccctgttttctggcacattctaccctgagatattcagcggcatatgcactgatgatgctccggccttctcacgtcagtgcatgtcacatgcatcctgctccaggactggtttcctagcctcccgctaagactagcacttagctcttcttggaaaaggacccaccctgcagcgctccagctctgttgtgtatgggaggtgctggtgtcagggttcacaagccatggaactaccttgcttcacatcacaaggcaaggtgaactcaactcccaataaactgcttgctggagcctccgaattctccgttttctgaattgcataggcacgataggggtcgggtctgtcctttgttggagtcagtccccccttttcttagcaagtcagtgtgttttagaagggaggtggcagcattgagggaaaccaggtcaccatccaccctcgtaacaacagtctccctgggtgggtcccagaagtgatctttgtgtcgctcgggtcggaactctttaggcctctggcctccaccctcccccaacagcagggatgggtcaggtggcagcatccaaaaccacggtgaagatactagggtccagaggccgactggagcaaggtttgctggcagatgaggcctcagtggaagtgacggctactgtggagatgcagtggaggacctggtggctgagccaggagatgcacaccttcgcttctctcaccaggaacattcgcttctctcaccaggaacatttatggtagtatgaggggttggaacattattactcaacccatttcaggtcctttcacattcttgagctgccatgttgtgcttttgtagagagatgattattgtactgtgggaggtcaggaagttcgagattccttcactgtcagaatgggctcaaggagccatcttttgtgataggtattggggaactaaggggtatctctgctacaggaatgggagtgagaacattcactttttgaaggacaagtatatgtgggtctatgatgatgtttttgtaaaacccttttgtgtatgtgtctgtgtgagtcctaatattcagtaagtattttcctctgtgtaactccctctaataggtgtagtcaacaaagctgtgctaatatctctgtccccttgatcctggcattctggaagacacgaaagcaagcaaggatatataaggcactgtggtggttattcccgaggagccagagaaacctggagaagagatcagaacacctggggtccttctatttgggagaatcttttagtatctgggctgttacacctgtgggtttgtgaatttgtgtctgtccacctgtatgtacagtgataacgtgtgtgatttttgtatatttgtctagagggctgtgtgtatatatatttatatatatttttaaatatggaatgcttttaggtttttttttttttttttttttgagatggattctcactgttgccaggctggagtgcagtggcacaatcttggctcactgcaacctccacttctcaggttcaagcaattctcctgcctcagcctcctgagtagctgggactataggcgcgtgccaccacaaccagctaaatttttttgtatttttagtagagatggggtttcaccatgttgaccaggatggtctcaatctcctgaccttgtgatccacccacctcggtctccccaaagtgctgggattacaggcgtgagccactntgcctggctggttattttgtttgtttgttgtttttttgagacacagtctcgctctgtcaccaagctggactgcagtggcatgatctcggctcactgcaatctctgcctcccaggttcaagcaattctcctgtttcagcctcctgagtagctgggattacaggcgcgtgccaccataccgagctagtttttttatttttagtagagacggggtttcaccatgttggccaggatggtctcgccctcctgaccttgtgatctgcctgcctcggcctctcaaagtgctgggattagaggcttgagccaccaggcccggctggaatgcttgcattttcttgcctgatttccctgggagcaccccccttaacactgaatggagctggtgagagcaaatatccttgtttctgatattagatattaaaaatatggtttttcaccatcaaagattttattgagtttttcatatatgccttgtagcaatttgagtaaattatattccttgtttgttgcagatttttaatcataaatgggtgttgaatta

SEQ ID NO: 28904 - DNA, 3139 bp, Homo sapiens
cgcttccgccggtgggacggaactggtgccctccgtggacaattgtgttgaagcagaaattgttccggatctcgggtcggacacggaagtcttcctgcagtgtttctggatgcggggacagggatgcgcaggaattccagtctcagtttccagatggagcgacccctcgaggagcaagtccagagcaagtggtcgtctagtcaaggccgcacaggaacaggagggtctgatgtcctccagatgcagaacagtgaacaccatggacaaagcatcaagactcaaactgactccatctcccttgaggatgtggctgtgaacttcaccctggaggagtgggctttgctggatcctggccagaggaatatctacagagatgtgatgcgggcaaccttcaagaacctggcctgtataggggaaaaatggaaagaccaggatattgaagatgaacacaaaaaccagggaagaaatctaagaagtcctatggttgaagcactctgtgaaaataaagaagattgtccatgtggaaaaagcactagccagattcctgatcttaatacgaacctggaaactcctactggattaaaaccatgtgactgcagtgtgtgtggggaagtcttcatgcatcaggtctcccttaataggcacatgagatctcacactgaacagaaaccaaatgagtgtcacgaatatggagagaagccacataaatgcaaagaatgtgggaaaaccttcactcgcagctccagtattcgaacccatgaaagaattcacactggagagaaaccctatgaatgtaaggaatgtggcaaagccttcgcatttctcttttcctttcgaaaccatataagaattcatactggagagacaccctatgaatgtaaggaatgtgggaaggcattcagatatctcactgctcttcggcgccatgaaaaaaatcacactggagagaaaccctacaaatgtaaacagtgtggaaaagcctttatatattaccagccttttctaacccacgaaaggactcacactggagagaaaccttatgaatgtaagcaatgtgggaaagccttcagttgtcccacgtacttacggagtcatgagaaaactcatactggagagaaaccttttgtatgtagggaatgtgggagagccttcttttctcactcaagccttcgaaaacacgtgaaaacccacaccggagttcaaccttatacatgtaagaaatgtggggaagccttcaagtcatctagttcctgtgaagtgcacgaaagaactcattttggagaaaaaccctatgaatgtaaacaatgtggtaaagccttcaattcttcaagttaccttcagttgcacgaaagagttcacactggcgagaaaacttacgaatgtaaagaatgtggtaaagcctttctttattccactcactttcgaatccatgaaagaacccatactagagagaaaccctatgaatgcaaacagtgtggtcgggtcttcatttacttcagtcaccttcgaaggcacgaaagaagtcacactggagtgaaaccatgtgagtgtaagcagtgtggcaaagctttcacttgtttaaattccctgaaagtacacaaaagaattcatactggagaaagaccctttcagtgtagacaatgtggtaaagccttcagttactcaaagtctttgcacgtgcacgaaaggactcatagtagacagaagccctaagaaagtaaagtgtggtaatgctgtcagttgtattagttccttttggatgtatgagagtacttacgctggagagaaattcaaggaatgtaaacggtgtgattaagccttcagttgtcctaattccctttgaagacgtgactcatgcggcaatgaaatatttaacaaatgggggaggaacttgcactctcctgcgggattgcagatatgtgaatggactccatggacagaaaagctacgaatgtatggagtgtaggaaagccttcacttcacgtaatcttttaaagacacctgagaatatatactggagagaaactataaagaaaattctatatccatcccatcttttgtggggtttgttttttgtttttgtttttgttgagatgtaattttgctcttgttgcccaggctggagtgcagtgagccgagattgtgccaccgcactccagcctggcaacagagcgagactctgtctcaagaaaaaaaaaaggaaatcctggctttctttaagccacagacttcctaaggctggtgggtcccagactccttgtactggccttgggtccctggtcaccttgcagtggccaccaacccccaggggctactgatagggctatccagtgggcttctggtagcttgggcaactgggcaggatctttatgggcagtcacaggtgccagcattggaggatggagttaggggttgaaaaagcaaaacctcgaacgaaccagcctgtagggggcctggagtggagctggatatacggggagtcacaggtgacgcgagggtcagtcagtctcctgagacgacaagaagcagacatatgccgtgagcaccattcgagagaaggtaccaaggatagggcccacgggggtccagggtgaaaatgggatggaagcatcaaagcgggggagacaggagccagtgggaaacgaagcgaagggggaaaaaacaagctgcaagcagtagggaacatccaaaggggacaacatcccgtctgacgcgaggaaacacgaaccccatgggaaccaagtgacacagcgtggcgatagggaacccgaaagcagggtgcaataccagggacgtaataagtaccagacgtgcacaagtagcaatacaggcaacggtacacagggcattaagggaaaatcgaggtagagacgtatgtggagcccccatgggcaaccaaggaggacgccaaaactatgcctgtgacaggtgccctacgcaaacagaataggagagcagcgacacattgacgaccatggggagaaagcacctaggaacacgaggtgtccaagaaggcgcacaacattcacgacttgagaaaccgctaaggagagagggcgccacataacacctcttcacaagacggagaagacagatatcagcagggaggacatcacaagaaccgggaggacatgagacg

SEQ ID NO: 28905 - DNA, 180 bp, Homo sapiens
caagctgcctggcggatgctacgctccactcaggggtctaccaccagggatcctggacctggggcctcccaaagtatttttcagtccttttgtagtcctcttctttgaaagaggataaatcattttttgttcttttacccaaacaccttgactataaatatgtgtaaattatgtattcat

SEQ ID NO: 28906 - DNA, 364 bp, Homo sapiens
ggtgtgagccaccgtgcccgaccccatttaatgttattattgacgtagttgtaattacatctgccattttagttttttgtgtttgtctcatgttgttttcttgctcctcctttgctgcattattttgcattaaatgattatttcctaattattttaatttctttaataattttttttactatctgtgtgtgtgtgttttgagatagagtctcactctgtcacccaggctggagtgcagcagggcaatcttggctcactgaaacctctgcctcctcttttcaagtgattctcctgcctcagcctcctgagtagctgagatttcaggtgtgtgccaccaagcctggctaatttttgtatttttttt

SEQ ID NO: 28907 - DNA, 930 bp, Homo sapiens
  misc_feature (264)..(264): n is a, c, g, or t
atgaagaaagaaaatcaatcctttaacctggattttattctcctgggagttactagtcagcaagaacagaataatgtcttctttgtgatttttttgtgcatttaccccatcacactgactggaaatctgctcatcatcttggccatctgtgctgacattcgccttcacaaccccatgtattttctccttgccaacctctccttggttgacatcatcttctcatccgtaaccatccctaaggtgctggccaaccatctcttgggnagcaagttcatctcctttgggggatgcctaatgcagatgtatttcatgatagccttggccaaggcagacagctataccttggctgcaatggcatacgatcgagctgtggccatcagctgcccacttcattacacaacaattatgagtccacggtcttgtatcctgcttattgctgggtcttgggtgattggaaacaccagtgctctcccccacactctgctcacagctagtttgtccttctgtggcaaccaggaagtagccaatttctactgtgacattatgcctttgctgaagttgtcctgttctgacgtccactttaatgtgaagatgatgtacctaggggtcggcgttttctctttgccattactatgcatcattgtctcctatgttcaggtcttttccacagtcttccaagttccatctaccaagagtctattcaaagccttctgcacctgtggctcccacctcacagttgtttttttatattatggtacaacgatgggcatgtatttccgccctctgaccagttacagccccaaagatgcagtgataactgtgatgtatgtggcagtgaccccagcattaaatcctttcatctatagtctgagaaattgggatatgaaggcagccctacagaaactcttcagcaagagaatctcctcatag

SEQ ID NO: 28908 - DNA, 419 bp, Homo sapiens
tttttttgagatggagtctcacttttgttgcccaggctggagtgcaatggcgcgatcttggctcactgcaaactccacttcccaagttcaagtgattctcctgcctcagcctcccaagtagctgggattacaggcgcctgccaccacacctggctaatttttttgtatttttagtagagatggggtttcatcatattgacaaggttggtctcgaactgctgacctcaggtaatctgcctgccttggcctcccaaaatgctgaggttacaggcatgagcctccatgcctggctgccaaaccctattttttaagaccatcacaagactaaagattctaataatctttaatcagtctttattgaaattacaaagagggactttatttgtgactttttggctttgaggcataggaactgtatg

SEQ ID NO: 28909 - DNA, 389 bp, Homo sapiens
ggtaaaagggaaagaagggggcgtgaaggcgaacggttgggaggggatgaagctgggggaggagaggccaggcccgggtcgcatgggcctgcagatcaggcttagcactccagacttcatcctaggagctgtgggaagccactgaggacatgtgtggcaggggtaagggcagacgctgtggtgagatcagagcacgtactctatgtcaggcacattgtcagttcttcttgtgccatcttacagaatccttgcagcagcctcagaagggcagggataatcaacctccattttaaaaatgagaaaacgtggtctcaaaggcataaacaggccgggtgcagtagctcacgcctgtaatcccagcactttgggaggccgacgtgggcagatca

SEQ ID NO: 28910 - DNA, 1687 bp, Homo sapiens
taagctattaatatttcctatcactttccatttataaacaatgctgagcttcagacacgtattatcttacatatgtgtgagtctgtctctaggataaattcctagaagtagaattcccgtgtcaaagaatatgcacatttaaaaaatgtatagacttcgggccggggcgcgggaaggtgcgggtcgtcggcggagagaagccagcagctcgagagacgcagggccaggaggacaggaccgtcccgcggtcacagcccggtccttcttccgctccccccgccccccccacgggccaccttccggtccgttctccccgcccggtcgccgcccgccagcccttcgtcccccagccgcccaacctcctaagcgctgaaggaattatttttgggagtcatgaccatagctgcctgcttcccccaaccctcgacgacgaaaaggacttcggcccccggccgggcggctccgggggaaaaaagagagagcgaccgccgccccgcgctcagggccactctagagggagaagctgccccgaggctggcagagcgcccagccgcggtggagaccggaagccttctggagcccaaggctgtgcacgtcccctgtgctgattctctgcctaggaaaggaccatgcagctggagatcaaagtagccctgaacttcatcatcttctacttgtacaacaagctgctctggcgcctctgaaaaagaaataagaagcccactggtaccctgacaaaccactgaagggctctggcttccacaccgaggagatggtggaccccgttggggagctggccgctaagcgaagtggcctgacagtggaagatgtgcgggccaatgtgcctgaggagctgagcatatggattgaccccttcggggtgtcctaccagattggtgagaagggagcagtgaaagtgctgtacctggatgacagtgacggctgtggggccccggagctggacatgaagatcaagagcagtttcactcctgacgaccagatgctctttctcctcggaagccaggacagctccttgtccaactccccgtcgctatgctttgcccatcacccagccccaccttcatcctctgcctcgcccagcccatcaccttcaccatggactcctttgctgccaccaaattaggctccactaagatgaagaagaggggtggggcaacaagtggtaggggtgcagccagcggtgaagcaggtggccagcagccagtacagcagcctccacggcccgcttcaacaccaacagcttgttgaaacacaggagtctttctctgtctgtgcattcattgaacttcatcccggccaaccggcctctcaatcccagctctcgccccaaggccacgtacagtctcaagtacaacagtggtggcttgcccagtttcttccttgatggggccaatggccagggtagtgacacccgagccctctttggaggcagtgggactgtcacctgcaacgccagcagcttctacatggtctaggtatttggaggtggtgccaccgcctcttcctggagaaggcacccttcatggaagacctcagctacaacctgaacaccatgcaatatcctagtcaaccgttccagtccgtggtgctggccaactgaccgtctacctgccctggggccgggagcacccaagaccacagaaaagagaaagaaaaggaaaggcca

SEQ ID NO: 28911 - DNA, 347 bp, Homo sapiens
ggagctgaagagacctggagccgacagacgggtctgggtctgccgcccaggatggagtacaatggtgtgatcttggctctttgcaacctctgcctcctgggctcaagccttcctcccacctgaacctcccaagtagcgggactgcagggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttggtaagagag

SEQ ID NO: 28912 - DNA, 385 bp, Homo sapiens
gtgtgttctctcaagtttttggcacctttgtccatgtcctctgtgtttagaatgcctttctccatctcatcgtacctctgtcctgccacactgcacttgacatcacccctttttaaactctttatttccccctttttaactcttttagggttttctctaagacctaagtccttcctccaagtactccccaagcctcctaagtcacagctcatttagtttgtcattctttgtgctgctgcaactgtagcacctaccttgtatttaaacagttttattattttgtttatttgagacagggtctggctctgtccccaggcagaggttgcagtgagctgagatcgtgctactgtactccagcctgggtgacagagcaaaactccatcta

SEQ ID NO: 28913 - DNA, 563 bp, Homo sapiens
ggggagccaggagagctgggagagccggggctgccgggtgaggtcggcatgcgggggccccaaggaccacctggactccccggacctcctggacgtgtcggagctcctgtaagtgaaggcacttgtctgggcaggggttctaccccttctccaggaatcaaaaaccaggttctagcaagttcctccacctgcatctagacagtaatgctgttttgccttactgatgccaatgaagtgttggtatctcctttcttagaccagaaattattagatgttacagtccataagaatcacccagagaacaagtttaaatgcatattcctgggacccctttctcacatcaagaagcagggtagatcccaggaatctgcatttttaaccagcaccacaggatttttgacacttgatctaaagaattcattttccccagcctgtcctgtactgtactcttgtaagaagggtggagtctactgaattcttagcccctggaacagtgccagactgtccagtatggtgttcagtatgtccagtgaataaagagatgaacaaacagatatggtgta

SEQ ID NO: 28914 - DNA, 2188 bp, Homo sapiens
gcatttcttcctttttttattcctcacctacttaaggttcgagctccctgagcccattggccaacacctctggagtctgaccacgcctagaaacactgcgcatgctccgttgctagccagcccaggcagggcgctgaatcggcacaaaccagtctcacttcttgtaccgcagtggggaggttggagagaattttttcccatgaaagggcatacgttgcccgtccccttccccgaagaacgcactaggaatactgttcctgcgtttgcatgagctgtggcaccagcaccgactcagccttccgggcctccctcatgcacggagcctctcactaggtctcacccgcggctgcgttggtgccgtccggcacggtcacgtgggcgagaaaatggcggcccccagaccgcactgcgggcgtcgcggcaggtgaagcggtggtggcagaggcgcctgcggttactggccgggccgacgggtcctgagtctccagagctcggtgaggcgtcccggaggcggcgatcacggttcttacatccccgcgtccccaggtttagcctgagcagggttgtggaaggccgggacccattgacagcacgatggtgacggagcaggaggtggatgccatcgggcagacgctggtggaccccaagcagcccctgcaggcccgcttccgggcgctgttcacgctgcgtgggctcggcggcccaggcgccattgcatggatcagccaggccttcgatgacgattccgccctgctcaagcacgagctggcctactgcctgggccagatgcaggatgcccgcgccatccccatgctggtggacgtgctgcaagacacccgtcaggagcccatggtgcgccatgaggcaggggaggccctgggggccatcggggacccggaagttctggagatcctgaagcagtattcctcggaccccgtcatcgaggtggccgagacctgccagctggccgtgcgcaggctggagtggctgcagcagcacggcggggagccggcggcgggaccctacctctccgtggaccctgccccgccggctgaggagcgtgacgtggggcgcctgcgggaggcgctgctggatgagtcccggccgctcttcgagcgataccgcgccatgttcgccctgcgcaacgcgggaggcgaggaggccgccctggcgctggccgagggtctgcactgtgggagcgccctcttccgccacgaggtcggctacgtcctgggacagctgcagcacgaggcggcggtgccccagctggcggccgccctggcccgatgcaccgagaaccccatggtgcggcacgagtgcgcggaggccctgggcgccattgcccggcccgcctgcctggccgcgctgcaggctcacgcggacgacccagagcgcgtggtgcgtgagagctgcgaggtggctctggacatgtatgagcacgagaccgggcgggccttccagtacgcggacggcctggagcagctgcgcggggccccctcctagggccccaccctcacccggagctcccggaggactcttgagggccgctcctcccccgcagagctttggcgtctaaaccgggtgtgtgtaaatcggtgtcatcgcttgtgtcttgctgggcgcacggttgctgtccccctcctccgtctgggaccgaggagctgccgttgtgctgtgactccctgagtcccctgactgctcctcggggcctggcgcagggctgtagcgtggaagtttccaggcttggggtgggactctgcgggaggctctgggatgcccggctcaggacaggggaggattgcgagggaagccaggggaggatcgcgagggaagccaggggaggatcgcgagggaagccaggggaggatcgcgagggaagccaggggaggatcgcgagggaagccaagggaggatcgcgaggggagccaggggaggatcgcgagggaagccaggggcagagctggggctctgggaagaggctgacgttatggtggcttcagcttcactaggaatgggacacagggtctgggggcctctgactcccccaccccgaggcctgggtagggacagggtggtggtccctgagtgggtcaggtagggcacaggggccagggagggacaagcagacctcagagcgctgcccagatggaatattaaattatttttgccaagaaaaacactgactcct

SEQ ID NO: 28915 - DNA, 1810 bp, Homo sapiens
cggacgcgtgggtcgacccacgcgtccggacccacgcgtccgtcccccagaccgcactgcgggcgtcgcggcaggtgaagcggtggtggcagaggcgcctgcggttactggccgggccgacgggtcctgagtctccagagctcggttcttacatccccgcgtccccaggtttagcctgagcagggttgtggaaggccgggacccattgacagcacgatggtgacggagcaggaggtggatgccatcgggcagacgctggtggaccccaagcagcccctgcaggcccgcttccgggcgctgttcacgctgcgtgggctcggcggcccaggcgccattgcatggatcagccaggccttcgatgacgattccgccctgctcaagcacgagctggcctactgcctgggccagatgcaggatgcccgcgccatccccatgctggtggacgtgctgcaagacacccgtcaggagcccatggtgcgccatgaggcaggggaggccctgggggccatcggggacccggaagttctggagatcctgaagcagtattcctcggaccccgtcatcgaggtggccgagacctgccagctggccgtgcgcaggctggagtggctgcagcagcacggcggggagccggcggcgggaccctacctctccgtggaccctgccccgccggctgaggagcgtgacgtggggcgcctgcgggaggcgctgctggatgagtcccggccgctcttcgagcgataccgcgccatgttcgccctgcgcaacgcgggaggcgaggaggccgccctggcgctggccgagggtctgcactgtgggagcgccctcttccgccacgaggtcggctacgtcctgggacagctgcagcacgaggcggcggtgccccagctggcggccgccctggcccgatgcaccgagaaccccatggtgcggcacgagtgcgcggaggccctgggcgccattgcccggcccgcctgcctggccgcgctgcaggctcacgcggacgacccagagcgcgtggtgcgtgagagctgcgaggtggctctggacatgtatgagcacgagaccgggcgggccttccagtacgcggacggcctggagcagctgcgcggggccccctcctagggccccaccctcacccggagctcccggaggactcttgagggccgctcctcccccgcagagctttggcgtctaaaccgggtgtgtgtaaatcggtgtcatcgcttgtgtcttgctgggcgcacggttgctgtccccctcctccgtctgggaccgaggagctgccgttgtgctgtgactccctgagtcccctgactgctcctcggggcctggcgcagggctgtagcgtggaagtttccaggcttggggtgggactctgcgggaggctctgggatgcccggctcaggacaggggaggattgcgagggaagccaggggaggatcgcgagggaagccaggggaggatcgcgagggaagccaggggaggatcgcgagggaagccaggggaggatcgcgagggaagccaagggaggatcgcgaggggagccaggggaggatcgcgagggaagccaggggcagagctggggctctgggaagaggctgacgttatggtggcttcagcttcactaggaatgggacacagggtctgggggcctctgactcccccaccccgaggcctgggtagggacagggtggtggtccctgagtgggtcaggtagggcacaggggccagggagggacaagcagacctcagagcgctgcccagatggaatattaaattatttttgccaagaaaaacactgactcct

SEQ ID NO: 28916 - DNA, 2160 bp, Homo sapiens
gcatttcttcctttttttattcctcacctacttaaggttcgagctccctgagcccattggccaacacctctggagtctgaccacgcctagaaacactgcgcatgctccgttgctagccagcccaggcagggcgctgaatcggcacaaaccagtctcacttcttgtaccgcagtggggaggttggagagaattttttcccatgaaagggcatacgttgcccgtccccttccccgaagaacgcactaggaatactgttcctgcgtttgcatgagctgtggcaccagcaccgactcagccttccgggcctccctcatgcacggagcctctcactaggtctcacccgcggctgcgttggtgccgtccggcacggtcacgtgggcgagaaaatggcggcccccagaccgcactgcgggcgtcgcggcaggtgaagcggtggtggcagaggcgcctgcggttactggccgggccgacgggtcctgagtctccagagctcggttcttacatccccgcgtccccaggtttagcctgagcagggttgtggaaggccgggacccattgacagcacgatggtgacggagcaggaggtggatgccatcgggcagacgctggtggaccccaagcagcccctgcaggcccgcttccgggcgctgttcacgctgcgtgggctcggcggcccaggcgccattgcatggatcagccaggccttcgatgacgattccgccctgctcaagcacgagctggcctactgcctgggccagatgcaggatgcccgcgccatccccatgctggtggacgtgctgcaagacacccgtcaggagcccatggtgcgccatgaggcaggggaggccctgggggccatcggggacccggaagttctggagatcctgaagcagtattcctcggaccccgtcatcgaggtggccgagacctgccagctggccgtgcgcaggctggagtggctgcagcagcacggcggggagccggcggcgggaccctacctctccgtggaccctgccccgccggctgaggagcgtgacgtggggcgcctgcgggaggcgctgctggatgagtcccggccgctcttcgagcgataccgcgccatgttcgccctgcgcaacgcgggaggcgaggaggccgccctggcgctggccgagggtctgcactgtgggagcgccctcttccgccacgaggtcggctacgtcctgggacagctgcagcacgaggcggcggtgccccagctggcggccgccctggcccgatgcaccgagaaccccatggtgcggcacgagtgcgcggaggccctgggcgccattgcccggcccgcctgcctggccgcgctgcaggctcacgcggacgacccagagcgcgtggtgcgtgagagctgcgaggtggctctggacatgtatgagcacgagaccgggcgggccttccagtacgcggacggcctggagcagctgcgcggggccccctcctagggccccaccctcacccggagctcccggaggactcttgagggccgctcctcccccgcagagctttggcgtctaaaccgggtgtgtgtaaatcggtgtcatcgcttgtgtcttgctgggcgcacggttgctgtccccctcctccgtctgggaccgaggagctgccgttgtgctgtgactccctgagtcccctgactgctcctcggggcctggcgcagggctgtagcgtggaagtttccaggcttggggtgggactctgcgggaggctctgggatgcccggctcaggacaggggaggattgcgagggaagccaggggaggatcgcgagggaagccaggggaggatcgcgagggaagccaggggaggatcgcgagggaagccaggggaggatcgcgagggaagccaagggaggatcgcgaggggagccaggggaggatcgcgagggaagccaggggcagagctggggctctgggaagaggctgacgttatggtggcttcagcttcactaggaatgggacacagggtctgggggcctctgactcccccaccccgaggcctgggtagggacagggtggtggtccctgagtgggtcaggtagggcacaggggccagggagggacaagcagacctcagagcgctgcccagatggaatattaaattatttttgccaagaaaaacactgactcct

SEQ ID NO: 28917 - DNA, 1386 bp, Homo sapiens
agcggaggcgggcattttccacacatccaccccaccaacatgagctctccggctgcttcttcccaggggaggccctgggggccatcggggacccggaagttctggagatcctgaagcagtattcctcggaccccgtcatcgaggtggccgagacctgccagctggccgtgcgcaggctggagtggctgcagcagcacggcggggagccggcggcgggaccctacctctccgtggaccctgccccgccggctgaggagcgtgacgtggggcgcctgcgggaggcgctgctggatgagtcccggccgctcttcgagcgataccgcgccatgttcgccctgcgcaacgcgggaggcgaggaggccgccctggcgctggccgagggtctgcactgtgggagcgccctcttccgccacgaggtcggctacgtcctgggacagctgcagcacgaggcggcggtgccccagctggcggccgccctggcccgatgcaccgagaaccccatggtgcggcacgagtgcgcggaggccctgggcgccattgcccggcccgcctgcctggccgcgctgcaggctcacgcggacgacccagagcgcgtggtgcgtgagagctgcgaggtggctctggacatgtatgagcacgagaccgggcgggccttccagtacgcggacggcctggagcagctgcgcggggccccctcctagggccccaccctcacccggagctcccggaggactcttgagggccgctcctcccccgcagagctttggcgtctaaaccgggtgtgtgtaaatcggtgtcatcgcttgtgtcttgctgggcgcacggttgctgtccccctcctccgtctgggaccgaggagctgccgttgtgctgtgactccctgagtcccctgactgctcctcggggcctggcgcagggctgtagcgtggaagtttccaggcttggggtgggactctgcgggaggctctgggatgcccggctcaggacaggggaggattgcgagggaagccaggggaggatcgcgagggaagccaggggaggatcgcgagggaagccaggggaggatcgcgagggaagccaggggaggatcgcgagggaagccaagggaggatcgcgaggggagccaggggaggatcgcgagggaagccaggggcagagctggggctctgggaagaggctgacgttatggtggcttcagcttcactaggaatgggacacagggtctgggggcctctgactcccccaccccgaggcctgggtagggacagggtggtggtccctgagtgggtcaggtagggcacaggggccagggagggacaagcagacctcagagcgctgcccagatggaatattaaattatttttgccaagaaaaacactgactcct

SEQ ID NO: 28918 - DNA, 1798 bp, Homo sapiens
gcatttcttcctttttttattcctcacctacttaaggttcgagctccctgagcccattggccaacacctctggagtctgaccacgcctagaaacactgcgcatgctccgttgctagccagcccaggcagggcgctgaatcggcacaaaccagtctcacttcttgtaccgcagtggggaggttggagagaattttttcccatgaaagggcatacgttgcccgtccccttccccgaagaacgcactaggaatactgttcctgcgtttgcatgagctgtggcaccagcaccgactcagccttccgggcctccctcatgcacggagcctctcactaggtctcacccgcggctgcgttggtgccgtccggcacggtcacgtgggcgagaaaatggcggcccccagaccgcactgcgggcgtcgcggcaggtgaagcggtggtggcagaggcgcctgcggttactggccgggccgacgggtcctgagtctccagagctcggttcttacatccccgcgtccccaggtttagcctgagcagggttgtggaaggccgggacccattgacagcacgatggtgacggagcaggaggtggatgccatcgggcagacgctggtggaccccaagcagcccctgcaggcccgcttccgggcgctgttcacgctgcgtgggctcggcggcccaggcgccattgcatggatcagccaggccttcgatgacgattccgccctgctcaagcacgagctggcctactgcctgggccagatgcaggatgcccgcgccatccccatgctggtggacgtgctgcaagacacccgtcaggagcccatggtgcgccatgaggcaggggaggccctgggggccatcggggacccggaagttctggagatcctgaagcagtattcctcggaccccgtcatcgaggtggccgagacctgccagctggccgtgcgcaggctggagtggctgcagcagcacggcggggagccggcggcgggaccctacctctccgtggaccctgccccgccggctgaggagcgtgacgtggggcgcctgcgggaggcgctgctggatgagtcccggccgctcttcgagcgataccgcgccatgttcgccctgcgcaacgcgggaggcgaggaggccgccctggcgctggccgagggtctgcactgtgggagcgccctcttccgccacgaggtcggctacgtcctgggacagctgcagcacgaggcggcggtgccccagctggcggccgccctggcccgatgcaccgagaaccccatggtgcggcacgagtgcgcggaggccctgggcgccattgcccggcccgcctgcctggccgcgctgcaggctcacgcggacgacccagagcgcgtggtgcgtgagagctgcgaggtggctctggacatgtatgagcacgagaccgggcgggccttccagtacgcggacggcctggagcagctgcgcggggccccctcctagggccccaccctcacccggagctcccggaggactcttgagggccgctcctcccccgcagagctttggcgtctaaaccgggtgtgtgtaaatcggtgtcatcgcttgtgtcttgctgggcgcacggttgctgtccccctcctccgtctgggaccgaggagctgccgttgtgctgtgatcccccaccccgaggcctgggtagggacagggtggtggtccctgagtgggtcaggtagggcacaggggccagggagggacaagcagacctcagagcgctgcccagatggaatattaaattatttttgccaagaaaaacactgactcct

SEQ ID NO: 28919 - DNA, 1024 bp, Homo sapiens
agcggaggcgggcattttccacacatccaccccaccaacatgagctctccggctgcttcttcccaggggaggccctgggggccatcggggacccggaagttctggagatcctgaagcagtattcctcggaccccgtcatcgaggtggccgagacctgccagctggccgtgcgcaggctggagtggctgcagcagcacggcggggagccggcggcgggaccctacctctccgtggaccctgccccgccggctgaggagcgtgacgtggggcgcctgcgggaggcgctgctggatgagtcccggccgctcttcgagcgataccgcgccatgttcgccctgcgcaacgcgggaggcgaggaggccgccctggcgctggccgagggtctgcactgtgggagcgccctcttccgccacgaggtcggctacgtcctgggacagctgcagcacgaggcggcggtgccccagctggcggccgccctggcccgatgcaccgagaaccccatggtgcggcacgagtgcgcggaggccctgggcgccattgcccggcccgcctgcctggccgcgctgcaggctcacgcggacgacccagagcgcgtggtgcgtgagagctgcgaggtggctctggacatgtatgagcacgagaccgggcgggccttccagtacgcggacggcctggagcagctgcgcggggccccctcctagggccccaccctcacccggagctcccggaggactcttgagggccgctcctcccccgcagagctttggcgtctaaaccgggtgtgtgtaaatcggtgtcatcgcttgtgtcttgctgggcgcacggttgctgtccccctcctccgtctgggaccgaggagctgccgttgtgctgtgatcccccaccccgaggcctgggtagggacagggtggtggtccctgagtgggtcaggtagggcacaggggccagggagggacaagcagacctcagagcgctgcccagatggaatattaaattatttttgccaagaaaaacactgactcct

SEQ ID NO: 28920 - DNA, 451 bp, Homo sapiens
tggatgggctcctgagagagtctctgctctgcttcctctgagatgtgatattttgcagcgggtgagggggtggtgctacattagggtctttaataaatatagatcccctctttaggggccttattgaggccctgaaaggatgtcttgggcagagacatgctctaactctccaggtgagagtgggcctcctccttgagtgcataaggagcagggagagacaggttggcatagggatggcaggtgtctaccttgacagagatatgagagtaaacaggtaggtaaatggccagttttaaagtacagctggaccaagggcatggtcacttagaaaacttgatgtgcatgttttcattttatggaacaatttaaagaaaaaaccaaaagtaaattattagctttttgttttgccagataaagatattaagccacaccaaatgataccaaaactatg

SEQ ID NO: 28921 - DNA, 489 bp, Homo sapiens
ataaaactcaggtgaaagaaatcaaagtaaagctcaatatcgagaatgatagtccatgttcatgaatgggaacactcaataatattaagatgtcaattatcccagactttgtctacagatttactggaattacaattcaaatatctgcaagtccttttgtagatatcaacaaacagaagctaaaatataagggaaggacaaagaccttcctagaattggcctagaatagtcaatacactaccgaagaagaacaaagttgagcccttttattaccaaatttcaagactcactataaagctataataatcaagacagcatatatttaaaagaataggtagataggtcaatgaaacagaattgagagcccagaaattaatctatgcagagtctgctgatctttaacaaaggaacaaaggcaagtcaatgaaaaaaaaaagtcttttcaaaaatggggctggaataattggacatacatataccaaaaaaaaa

SEQ ID NO: 28922 - DNA, 2050 bp, Homo sapiens
agtaaatgaagaggaaaatgctaacatgccatattggacaccacttgtctttcgatgccaggtcccttttcagccgaatatgtcagaattttctaggctccatcttttcttttattcctcttgcagcaaccataggctttgatggcttctcacaggacagaaaacctggatcatcccaaacctgctctgtgaaccctctacttcatgtatgggtttcctcccatgctgcacactgtgagggtcatgcatcaccacagcatgcacagctgagaaatgtggagagtgaaggacccaggccacattgactgtggggatgtaagccagtggagacacacttcctgaagtaagatgcatttcacaaagctcccagtttccagaaggatggagcaccagtcacccttggtcatggccaaaccctctttgtccttgccctttcctgctctctgggatcacagaacatgtgcactggacacagcttctgccttggaaacacccagactaaggtaatttctcacacaccagtttatcttccagcttctgtcagaactttaggtcaagtattatgagccagatagagtaaaaaatataaactttaaaaattataatcaccctcaacatggcaagcttctcatggtaagaaagaaatgcaagaattcagaaactaacccagggaatagcaggctcaagatttcttggcaaataaattcacttaatagatcacagatattttctcatctcaacacatgctgtgcacaggtatatttcaaacctaatcaccgtggaatttctcattttcattattacaaacaaagctacaataagttcatgtgtattgaaatccttgcaaacttgactagtagctcaagataaattttagaataaaaaatcaaatggtattcacatgtatatactctgaagcatatatttggtcttcaacaggtttccaggcatacaactactaaaatccttggattccttaaagtggtacttgtatgttaatgagttgacaaatggctagtagtccctacgtagcttcaggatgggagctgggcacctgaaagaccaaggcagaattagagaattaagatagtcagacccagcccccaacctccatggagggaagaagggatgaatgttaagcagaacaccaatggccagtgatttaatcagtcatgcctacagaatgatgcctccataaaaaccctcaaggactgggttcagagggcttccagatagctgaagacgtggaggttcctggaaggtggtgaacctggagagagcatgcaagctccacagcctttccctatacctcaccctatgcatctcttcatctgcatctcttgcgatatcctttacaataaactgctaaatgtagatgcctccatgagttctgtgggctgctctagcaaattaattgaacccaagaagggggctgtggtaacccagacttacactggtgtctgccataggattgattgtttgcttggtgtatgggcttaaccccatcacctttagtcacagaagtcttctgtgttgattgttgagtgagagaatagaaaaagcgctttagtttgtttttccttatagaacatgttgacattatgtggacatatttaaatttcccttcagacaccaaattcgtacttttgccaataatgtgtacaaaggcatatattctcacagtttcactaacatttgattttgttagtaactttagttttacttgcaaatcttacctcagtatcattttatttggcattgatttaatcattagtgaggtttaacatcttctggtatgttttggggctatttgtgtttcttcaataaattgtttttttcttaaattttcattgttttacctttttgcttactgatttgtagcggtagttgacatgattctacacatctttgtcatcatataagtgttgaatcgtttttctagtgggacgttttatccttttgctatgttttgtttgtttcctttgtggtacaaaagttttaaatgttatatgtattaaataaactatcaatcatgcctttaaaaaatcta

SEQ ID NO: 28923 - DNA, 738 bp, Homo sapiens
gtcagacacacaggtaaaaagaacttgaggcttataattggtattggaaacggggatgtcttatgagacttagccctcacccagcagacttggcgttatttccaggtagatagtgtcaaaactgaattgaaggacacccagctggtgtctgccataggattgattgtttgcttggtgtatgggcttaaccccatcacctttagtcacagaagtcttctgtgttgattgttgagtgagagaatagaaaaagcgctttagtttgtttttccttatagaacatgttgacattatgtggacatatttaaatttcccttcagacaccaaattcgtacttttgccaataatgtgtacaaaggcatatattctcacagtttcactaacatttgattttgttagtaactttagttttacttgcaaatcttacctcagtatcattttatttggcattgatttaatcattagtgaggtttaacatcttctggtatgttttggggctatttgtgtttcttcaataaattgtttttttcttaaattttcattgttttacctttttgcttactgatttgtagcggtagttgacatgattctacacatctttgtcatcatataagtgttgaatcgtttttctagtgggacgttttatccttttgctatgttttgtttgtttcctttgtggtacaaaagttttaaatgttatatgtattaaataaactatcaatcatgcctttaaaaaatcta

SEQ ID NO: 28924 - DNA, 2221 bp, Homo sapiens
aggcggtccagaggcggccggcaggtccacgtcctgggcgaccgctctgtcgcagttgggcgagacctacctagtcctgacgggtcgtatttccaagacattttcatattctatccattgttttgtgtgcattttattacttctgtatatagaggtaacaacgctaagcttttttgagatgtctgtttcttctagatgttctgaagtacctgatacatgttaaaattagaggttcatgcatgttgtgaagacaggattttgaacgctctcaccacaaagaaatgacaagtgtttgagcaaccataggctttgatggcttctcacaggacagaaaacctggatcatcccaaacctgctctgtgaaccctctacttcatgtatgggtttcctcccatgctgcacactgtgagggtcatgcatcaccacagcatgcacagctgagaaatgtggagagtgaaggacccaggccacattgactgtggggatgtaagccagtggagacacacttcctgaagtaagatgcatttcacaaagctcccagtttccagaaggatggagcaccagtcacccttggtcatggccaaaccctctttgtccttgccctttcctgctctctgggatcacagaacatgtgcactggacacagcttctgccttggaaacacccagactaaggtaatttctcacacaccagtttatcttccagcttctgtcagaactttaggtcaagtattatgagccagatagagtaaaaaatataaactttaaaaattataatcaccctcaacatggcaagcttctcatggtaagaaagaaatgcaagaattcagaaactaacccagggaatagcaggctcaagatttcttggcaaataaattcacttaatagatcacagatattttctcatctcaacacatgctgtgcacaggtatatttcaaacctaatcaccgtggaatttctcattttcattattacaaacaaagctacaataagttcatgtgtattgaaatccttgcaaacttgactagtagctcaagataaattttagaataaaaaatcaaatggtattcacatgtatatactctgaagcatatatttggtcttcaacaggtttccaggcatacaactactaaaatccttggattccttaaagtggtacttgtatgttaatgagttgacaaatggctagtagtccctacgtagcttcaggatgggagctgggcacctgaaagaccaaggcagaattagagaattaagatagtcagacccagcccccaacctccatggagggaagaagggatgaatgttaagcagaacaccaatggccagtgatttaatcagtcatgcctacagaatgatgcctccataaaaaccctcaaggactgggttcagagggcttccagatagctgaagacgtggaggttcctggaaggtggtgaacctggagagagcatgcaagctccacagcctttccctatacctcaccctatgcatctcttcatctgcatctcttgcgatatcctttacaataaactgctaaatgtagatgcctccatgagttctgtgggctgctctagcaaattaattgaacccaagaagggggctgtggtaacccagacttacactggtgtctgccataggattgattgtttgcttggtgtatgggcttaaccccatcacctttagtcacagaagtcttctgtgttgattgttgagtgagagaatagaaaaagcgctttagtttgtttttccttatagaacatgttgacattatgtggacatatttaaatttcccttcagacaccaaattcgtacttttgccaataatgtgtacaaaggcatatattctcacagtttcactaacatttgattttgttagtaactttagttttacttgcaaatcttacctcagtatcattttatttggcattgatttaatcattagtgaggtttaacatcttctggtatgttttggggctatttgtgtttcttcaataaattgtttttttcttaaattttcattgttttacctttttgcttactgatttgtagcggtagttgacatgattctacacatctttgtcatcatataagtgttgaatcgtttttctagtgggacgttttatccttttgctatgttttgtttgtttcctttgtggtacaaaagttttaaatgttatatgtattaaataaactatcaatcatgcctttaaaaaatcta

SEQ ID NO: 28925 - DNA, 511 bp, Homo sapiens
tcagttaaatacacaaccacctacaggacttgaaattcagttccacaacctcaagcaaaagacacacagtctcaatggttattctccttttcagtgaaaaatgaatgttttctttatggatttaagcagacaaatagacacacaaaaaatatggaacaactaaccatattctctgtcttctaccactcaacaaagaatatattctcatcatcctaatataggttaccaagtgatcttgtcataaaaccagattgctaattattgtcattccaaagggggaacattttatagattatgtgacctctactcacctagttattcagtacctactagtctctggaatcggctgttttatacacctgttttatacatgagggttctcttgattacataattaagcccaaccttgtgatccagtagcagttgtgaaaatggacataatcctagacaataagttaaacaaatgtggaacttcctggccaagatcaggagcgacaatgaaacaaaccag

SEQ ID NO: 28926 - DNA, 224 bp, Homo sapiens
gtggagtatttatcgcctgtagacactgggcccccacattgtgctaggccaggagtgctgagtcctggaattcagatcatagcagtggatacaagtgaacagtgcttgtgacaatttctgtaatagactgatacagaaagctcagttgaagggctcttaatgcagtctttgggaggggaccaggaaagcttcccagagaaagtgacatggaaccaaaacttgga

SEQ ID NO: 28927 - DNA, 955 bp, Homo sapiens
tcagtcactctttcaccctgccaaagcttcactgtcctactgattgaattgtatgtgagaaataaaatgtcatcatattaagccactgggatttgtatgtttatctgttatagcagcaagtcttaatttacctaatacacacattgtgacagatgttcttaatgtcccaccccatattgttacatgtccagctttgagatccctgcatgtggggtagagtttctggcatgctgatcaattcccactttaagcatctgtggcctctgtgcctctgtgcctcactgtatgaaggatttatctggcaccatagaaacttaccatgcacagtgacaacctagaagagtgagagagagcctcagccaacaggggaccagagtcagtggataagatgcttgaggctttccatctaccagtgagataaatatgaagcatgtttcatatggttctcagagggttcacagtgggatttagccccagtgcccacagtactctgctcgttaacgtactgtttatattggcctttctccattccccatctcacatatacttcctggaatcacatcaaataaactgcacctaaggtcttctatctaggtcagcttttgggggacccaaaagaagacacatatctaatatagcttatctcacattgctttaaacctttgtgcttatgtctatgtcttccactagattatgagactcctaagggactatagtaggtagaattttagatggctcctaagattcctgcttcctggtacacatgctctgaataatctccccttgagtgtgagaaggacttttgaatatgatatagtcactcttttgattaggctacaatatatggcaaagataatgattgttactttatacacaatttagctgactaaagtcagagattcccctgctgaccttgaaaaagcaagtcacccttcagtataataataataaaatc

SEQ ID NO: 28928 - DNA, 315 bp, Homo sapiens
agggtgactgcagtctcaatttacatcttatgtccggacgtcccattcaatgtcgcattcattccagacaaaagcgtcccagtttagatgacagattatatgactgcccttttttgtcctcaaggtatgatccaaagggaagcatctttctctgccattgctgtttcccacgcgggccaactgctcagatgttcaagtggagtcgcggctcggttatccaatctgctccaaacaaagctcctttaataaagtgagacttggctggaaggagctgaaaatgatcttggatcctaagtactggactggggccgagac

SEQ ID NO: 28929 - DNA, 305 bp, Homo sapiens
catcagtggtggacataggggttgtttccactgttggggttgtgaatagtgctgctgtgaacattcttgtgcaagcttttgtctgaacaagtgtatttaatttgttttagtctatactaagagtggaatttcagggtcctgtcgtgcttctgtgtttagcttaaggtggaactgccaaacttccacggcagctgtacccttttacattcccactagcaatgtgtgagggatctcatttctccacatcttcaccaacacttatatttcattaaagattttttattataaccaccctagtgggtgtg

SEQ ID NO: 28930 - DNA, 668 bp, Homo sapiens
ggtctcaaactcctgacctcaagtgatctgcctgcctcagcctcccaaagtgcaaggattacaggcatgagccaccatgcccggcataggcatggttttgacaatctgtctctttgtgccctggctccttctccaactcctctttggaggaggcacaggaggaggggtcatttcactgttcctgaaaagtagacatataacctacatgcaactgccaggtgataagggccccatctgtctggcatgacgttggaggtccacaaaggctgattagatgaatgctcagctctggggcctccccacagagctcacagacaggcgtgaaggaaagcaggactcttattagaatatgttcagagttttcactgaagaagcctcctgtgtgggccaggcactgtgctcagtgctttgattcacagtctcatttaattctcaccatttacagacaagaattcagctaagatccttttcaatcaagtctggcaatatctgcctttcaatggcagtgcctagtcctttcatatgtaatatacttatcattatgggtgggtttaagttttatcatcttgctatttgttatctatttgtcccccctcttttgttcctcctttactgccttctatttggttgagacttaataaaatattttattccatcttctctactta

SEQ ID NO: 28931 - DNA, 440 bp, Homo sapiens
gggaagaagttctggcatcatctaaatgtttagagattcaagcaaatgaacatttgtctcttgatgctaaatccatcactttttgggtaaggaataaagcattctcctttcaattatattcaggctattttgagattttaaatattattcatattggcagagaatgtacacatgtatgcatatacacatacatgcataaatagatgtgtgttctatctatctatctgtctgtctgtctgtctgtctatctatctatccatccatccatctcatctatttatctacaagaatgccaagcacagcgtttattttgaagccaagaatacatttttttaaatattttaattttctttttttctggaggacagtaactctttttttcaagtgtactttccaaccacaaattatgcaacccttctacagagcagagtgtttaggac

SEQ ID NO: 28932 - DNA, 915 bp, Homo sapiens
atgaaggagagctttagaaagatgtgtttgttgtctgtgtgcttcattgcaacagccctgccacactaggaggaagacaggttttgggtcctgtcttggtgataaagataaaactaaaggacaatcaaatctcatcaaacttctctctgaggagctgatgacgtttcagaaacagtgacaaagttcagaatcccattcttccatcctagatgggaaacatcaactttcctgatgatgctgaaaaagcaagatactcattttttccagccacccttgcagagccagaaagcccatgagattcaatagatgtaagactgagagagattttcattcctggatgaaaggagacaggcctgggagaagagttttctcttgccatctttgcagtctctccactcctgacgtgtacagggtcaggaaaggccatgtgaaaacatggcgagaagacagtcatctgcaacccaaggagagagacttcaccagacactgaccctgctggcaccttgatcttggacttccagtgttcagaactataagaaataaattcctgttatgtaaggtgcccagtccatggtattttgttgtaacagcctgagctgttgaagatggattttcctttcaagatcagatcttgggcctcagagtcagcctcactatagaaagcaagggctagtctcagcttcccacagaagacttggttttattggaggcaagttttgtcttgcttacaatgaggttatacaaagcataacaaaattcacattttgttaagtgactaccatatgatcactctgaattttattttacctgtcatttctcggtatcaataggttttacttccccttgttctggatttcagtgattgatgactgaatacaataaatatttattgagcgccttttatgaggagatatt

SEQ ID NO: 28933 - DNA, 914 bp, Homo sapiens
  misc_feature (861)..(861): n is a, c, g, or t
atgaaggagagctttagaaagatgtgtttgttgtctgtgtgcttcattgcaacagccctgccacactaggaggaagacaggttttgggtcctgtcttggtgataaagataaaactaaaggacaatcaaatctcatcaaacttctctctgaggtaagctgttgaatacaatattttattgaatataataaaagcaaagagaaatgtcaccaataatgataccagaatgcatcctgtatttccattaatgaggaaactgttctggaattaatacatggaattgattgtatggtatattgcctatttgcagtgtcatcccatgccattatctaactatttacagaaaaaaaaaagaaaaaacttctatgtaaaagcaaggaaaatgagagaaagaataatttcaaagggggatctaatttcagatgatgaatgccagctgtcaatgaacctataccgactgtgtttttgataaaactaatagtccaagcacctagaactgttacccctttaattgttgatccctcattttttaaatcataaatatgagtggctacctgcctccttcacaaggtcgtggtgagaagcaaattgatgccagtgccattttttccacctcaattccttgggttgcacaattttgtgggaatttcctgggaaaacttcaaagcaatttaaatagatctgtcccaaccatgcaattacaggagctgatgacgtttcagaaacagtgacaaagttcagaatcccattcttccatcctagatgggaaacatcaactttcctgatggtgagtttgtcagagtccattcccaagagtgggggtggggaggtgggggtggagagctgttgacaaggcggttgcnctctagggcgtttttttttgttcttgtgattcatgtatagagaaagccgcaag

SEQ ID NO: 28934 - DNA, 902 bp, Homo sapiens
atgaaggagagctttagaaagatgtgtttgttgtctgtgtgcttcattgcaacagccctgccacactaggaggaagacaggttttgggtcctgtcttggtgataaagataaaactaaaggacaatcaaatctcatcaaacttctctctgaggtaagctgttgaatacaatattttattgaatataataaaagcaaagagaaatgtcaccaataatgataccagaatgcatcctgtatttccattaatgaggaaactgttctggaattaatacatggaattgattgtatggtatattgcctatttgcagtgtcatcccatgccattatctaactatttacagaaaaaaaaaagaaaaaacttctatgtaaaagcaaggaaaatgagagaaagaataatttcaaagggggatctaatttcagatgatgaatgccagctgtcaatgaacctataccgactgtgtttttgataaaactaatagtccaagcacctagaactgttacccctttaattgttgatccctcattttttaaatcataaatatgagtggctacctgcctccttcacaaggtcgtggtgagaagcaaattgatgccagtgccattttttccacctcaattccttgggttgcacaattttgtgggaatttcctgggaaaacttcaaagcaatttaaatagatctgtcccaaccatgcaattacaggagctgatgacgtttcagaaacagtgacaaagttcagaatcccattcttccatcctagatgggaaacatcaactttcctgatggtgagtttgtcagagtccattcccaagagtgggggtggggaggtggggctgaaaaatgtgtcaggtgtagataacaggtatgttatctatatggttgaataatggggagagaagtta

SEQ ID NO: 28935 - DNA, 1691 bp, Homo sapiens
atgaaggagagctttagaaagatgtgtttgttgtctgtgtgcttcattgcaacagccctgccacactaggaggaagacaggttttgggtcctgtcttggtgataaagataaaactaaaggacaatcaaatctcatcaaacttctctctgaggtaagctgttgaatacaatattttattgaatataataaaagcaaagagaaatgtcaccaataatgataccagaatgcatcctgtatttccattaatgaggaaactgttctggaattaatacatggaattgattgtatggtatattgcctatttgcagtgtcatcccatgccattatctaactatttacagaaaaaaaaaagaaaaaacttctatgtaaaagcaaggaaaatgagagaaagaataatttcaaagggggatctaatttcagatgatgaatgccagctgtcaatgaacctataccgactgtgtttttgataaaactaatagtccaagcacctagaactgttacccctttaattgttgatccctcattttttaaatcataaatatgagtggctacctgcctccttcacaaggtcgtggtgagaagcaaattgatgccagtgccattttttccacctcaattccttgggttgcacaattttgtgggaatttcctgggaaaacttcaaagcaatttaaatagatctgtcccaaccatgcaattacaggagctgatgacgtttcagaaacagtgacaaagttcagaatcccattcttccatcctagatgggaaacatcaactttcctgatgatgctgaaaaagcaagatactcattttttccagccacccttgcagagccagaaagcccatgagattcaatagatgtaagactgagagagattttcattcctggatgaaaggagacaggcctgggagaagagttttctcttgccatctttgcagtctctccactcctgacgtgtacagggtcagatttctgttggctgctgtggcaaatgtcacacacttagtgacttcaaataacccagatgtatcatctgacagggtggagatggccccagtgagatgaacctggtatctcagttggaaatgcagaaatcacccgtcttctgcgtcgctcacgctgggagctgtagactggagctgttcctattcggccatcttccgctttaagttttttataatctttttgggaaggaaaggccatgtgaaaacatggcgagaagacagtcatctgcaacccaaggagagagacttcaccagacactgaccctgctggcaccttgatcttggacttccagtgttcagaactataagaaataaattcctgttatgtaaggtgcccagtccatggtattttgttgtaacagcctgagctgttgaagatggattttcctttcaagatcagatcttgggcctcagagtcagcctcactatagaaagcaagggctagtctcagcttcccacagaagacttggttttattggaggcaagttttgtcttgcttacaatgaggttatacaaagcataacaaaattcacattttgttaagtgactaccatatgatcactctgaattttattttacctgtcatttctcggtatcaataggttttacttccccttgttctggatttcagtgattgatgactgaatacaataaatatttattgagcgccttttatgaggagatatt

SEQ ID NO: 28936 - DNA, 1466 bp, Homo sapiens
atgaaggagagctttagaaagatgtgtttgttgtctgtgtgcttcattgcaacagccctgccacactaggaggaagacaggttttgggtcctgtcttggtgataaagataaaactaaaggacaatcaaatctcatcaaacttctctctgaggtaagctgttgaatacaatattttattgaatataataaaagcaaagagaaatgtcaccaataatgataccagaatgcatcctgtatttccattaatgaggaaactgttctggaattaatacatggaattgattgtatggtatattgcctatttgcagtgtcatcccatgccattatctaactatttacagaaaaaaaaaagaaaaaacttctatgtaaaagcaaggaaaatgagagaaagaataatttcaaagggggatctaatttcagatgatgaatgccagctgtcaatgaacctataccgactgtgtttttgataaaactaatagtccaagcacctagaactgttacccctttaattgttgatccctcattttttaaatcataaatatgagtggctacctgcctccttcacaaggtcgtggtgagaagcaaattgatgccagtgccattttttccacctcaattccttgggttgcacaattttgtgggaatttcctgggaaaacttcaaagcaatttaaatagatctgtcccaaccatgcaattacaggagctgatgacgtttcagaaacagtgacaaagttcagaatcccattcttccatcctagatgggaaacatcaactttcctgatgatgctgaaaaagcaagatactcattttttccagccacccttgcagagccagaaagcccatgagattcaatagatgtaagactgagagagattttcattcctggatgaaaggagacaggcctgggagaagagttttctcttgccatctttgcagtctctccactcctgacgtgtacagggtcaggaaaggccatgtgaaaacatggcgagaagacagtcatctgcaacccaaggagagagacttcaccagacactgaccctgctggcaccttgatcttggacttccagtgttcagaactataagaaataaattcctgttatgtaaggtgcccagtccatggtattttgttgtaacagcctgagctgttgaagatggattttcctttcaagatcagatcttgggcctcagagtcagcctcactatagaaagcaagggctagtctcagcttcccacagaagacttggttttattggaggcaagttttgtcttgcttacaatgaggttatacaaagcataacaaaattcacattttgttaagtgactaccatatgatcactctgaattttattttacctgtcatttctcggtatcaataggttttacttccccttgttctggatttcagtgattgatgactgaatacaataaatatttattgagcgccttttatgaggagatatt

SEQ ID NO: 28937 - DNA, 444 bp, Homo sapiens
tgtgggtatataccttatgtggaattgttgaatcatatggaagttctatttttagtttttgttgttgtccctttgttttcttttttcaaaaatttcagttgtttttgggatacaggtggtttttggttacgtagatgagttctttagtggtaaattctgagattttagtgtacttgtcacctgagcagtgtacggtatactcagtatgttgtcttttatccttcacctccttcctaacctcccctcctcctgagtccctacagtccattatatacctctgtatgttttgcattctcatagcttagctcccacttataagtgagaacatatggtatttggttttccattcctaagttccttaacttagaataatggcctccagttccatccaagttgctgcaaaagacattattttgttcctttttatggctgagtggtatttca

SEQ ID NO: 28938 - DNA, 389 bp, Homo sapiens
ccttttcttgattggaaacctgtataaatggagaagtagagggttaactttttaagccagcattcggatattttcattgttgttttaattatttttattaaaaaacgtaagtagagggtctctttgtgttgcccgggctggtctcaaaactcctgggctcactccttggcctcccaaaatgctgggattacaggtgtgagccacggtgcccaatgtgcacgttttcattgttggaaaaaaggcttggctgggtgtacccagcctgtaatctcttggggaggccaaggtaggaggattgtttgagcccaggagtttgaggctgcagtgagctatgatcatgccactctagcctgggcaacagagtgagaccctgtctcaaaaaaagagaa

SEQ ID NO: 28939 - DNA, 574 bp, Homo sapiens
  misc_feature (21)..(21): n is a, c, g, or t
ctagaggatcccccgcttgcngtcttaactattttggttttggatgcaattttttttttttgcaagattaagtcatgagcctgttttggtgaggcttggttaaaactgggtaataaaatctacaaatctatgtaattaaacacaagtgaatacatgctgtgttttgattgtgtccctcaaatttcatgtgttggagacttaatccccaaattcatatgttgatgacatttggaggtgatagtttttacactaataatgtgattgatcatgtacttcttgagtttcttgttaatgatggaagatccacctttattggtcaccttctggaagtggtgttaaagttactggtatataaccaggttctctcaagcattttcaaagtaacaatccactggtgagtttttccttcccagtgtgatttatttgttcagtaattcagtgtctactgcattttattttcaaatatgtttatatctatttctctatatctagacactaacattttatcagcatatatatcttaagaatcatgtatgttcaaggcattattcttagttctgttagggaacagcaa

SEQ ID NO: 28940 - DNA, 606 bp, Homo sapiens
ttgcttttctttagaatttttccatgttaaaaaaacttcctaattgtgtgtaggtggcagatcttagaagatgtctgctaagtcaacagtgtctttctatgctgtaagccttatctaaaattaatacttcgtttactttagataaaatgctctgaaatacatttttggaagcaaagctttttgtttggagacaaaacacaaaccttacagccatttattttattacaagaagtaaatatatttagtttatgtagtacacaaaggaggtgatagtttttacactaataatgtgattgatcatgtacttcttgagtttcttgttaatgatggaagatccacctttattggtcaccttctggaagtggtgttaaagttactggtatataaccaggttctctcaagcattttcaaagtaacaatccactggtgagtttttccttcccagtgtgatttatttgttcagtaattcagtgtctactgcattttattttcaaatatgtttatatctatttctctatatctagacactaacattttatcagcatatatatcttaagaatcatgtatgttcaaggcattattcttagttctgttagggaacagcaa

SEQ ID NO: 28941 - DNA, 1249 bp, Homo sapiens
ctatagtagacacaaaaactataatatctttaaatgttttctctttatttcttaacttcattgaggaaaaactcatattctagacagatattcccattggtttcacttagttgctctagaatttctgaataacttggtaaatagcctggaattttattttttaattgttctttacacaaaacatttatttttcattacagtttagtgaacagtttactaaccataataataatacatttaacttaattatgtatattcaccaaaagtagtaattgagaagattaatcctcctttatttcaagattttactttatttgtatttatttatttgagacaaggtctcactctgtcaccaaggctagagtgcagtgctgtgattataactgactgcagcctcaacctcctgggctcaagagatcctcccactgcagcctccctagtagctgggactacaggtgtgcaccaacacacccagcttattttttattttttgtagaggtgaggtttcaccatgttgcccaggctggccttgaactcttgggctcaaaatatagccttggcctcccaaagtgctatattttacgttttaaagatgtcaataaaaaatctaaaataggccttttgaatgtaggttttgttgaaacagaagaaacgaaaattatttaataaaataaaataggcctggttgcccatttttttaaatatacttaaatgtaaaggatagataagaaagaacaaaagaatgaataatgagtgaaaaatctttaacctctgcaggcctagatctgaaaaaaaaaaaaatttttttaataaaattaaaataaaattttacaaaatattttaaccactatagttttgagatcttgtggtttcccatccaacatgtaaagaggttggaagttgtactcttatcctcaccaaaaaaaagaacaaactgaaaatcaacagctcttcttagatccatcaaagaatgaagacacgggacagaccactgcccccaaaaccagaacagacaaatacagagaatcacagattactgagtagaagccgcagctagagccagcaactggtaggaacacttcaagggcgattgactaattgctagagactgagaatgagactcgtttaaaacattaagaactcctggaggcccagccttagagtacctatcaagttctcagggtcaaaagctgaggggaaaatgcccttgtgtttctgtgtgtgtagagggaagagagtaaacatttta

SEQ ID NO: 28942 - DNA, 371 bp, Homo sapiens
ctgcagcttctctcttaaacacagcattataatgcttgtatttgtattctttcaccacttagctttcagttaatgcacattatctgaaaactttgttatataatccgcaatctttcctccaatcccaattactgcaattatccttccatttttacctgaatgatggagtaaaaatccctgctcttcagcttcctcacttcttcatctcctttatttttcatctccattctacctctgatagaacggagatgaaggccgggcgcggtggctcacgcctgaaatctcagcactttgggaggctgaggcaggtggaccaccaggtcaggagatcgagaccatcctggctaacatggtgaaaccccatctctact

SEQ ID NO: 28943 - DNA, 1575 bp, Homo sapiens
  misc_feature (2)..(2): n is a, c, g, or t
  misc_feature (5)..(6): n is a, c, g, or t
gncannaggctttccatagtggagcctgggctactctgaaatagaagcacctctccttcctttggacccctggagcactgtgttctacagttcttagctctttttctgtgtgcattatttgtatgtcttatccttggtggtcaaccacttcaaggtgagagactggggtggtggttccttttttttattttttaatctcccctgccccatctttctctttcccacttcctatgttgactgacaaaatcttcgtatttcccagagtaccagagtttttctgtgagaggctaggtcagtgtttctccccaagcagaggctaagaagtacctgatgcagtcatttattttcagaatgtgtgtagcttgcctccagcggattgcctgggaagctggagatgtgcttcaggggaaaggtggtccatccacttttcctgaacaggctgtgcatgcagccttgacatagccaactctgcaggagcatgaaagaactgaagatacagtattcgacttccagtatttctaatcactttagagacaggatgacgattggtttagaagagccaggggatgactaaggagcacatgtaaaacaataatgttcagtatagactttagtttctgatttgaaacattttctaaaaaatcatgtatctttaaaaaattggaagcagctcagtgtttgctggagatgaggcatagagtgtggtggaagggagggatgacaaaggggcaggcagagactttgagggatgaggggtgtgcacatcaccttgctggtggggactgtttcatggttggatacatgtgtgaaagcatatcaaattgcatgctttaaatatgtgcagtttcctgtgtatcaagtatacctcaataaagtagttaaaaatggtatacctttattatgctgaaagaagggaaaatttggaaaggagatgtttttctgtagaagatagcttctagaaaggaaaatcaaacacagtctaagttattctctgttttgttctcctccctccacagatgtcttgttgttttgggtcctcttatctaaaatttcacaatatgtgaaagtagcctgaactctaaaggtagtagttgtggttttgggaaactgtgtgttcgtactgcctctgtaaatggaacacaagcctctcctaccctctggggagcttgtcacttagtacagttttttaggaactcctaagaagtttaagttctggccacaggtcccagagttaaggatgttgtcaactctgctactcatttgaaaaatgtcttgtggaacctatagccgcagaaagagctttgtttctctgggtgaaaacaacatacattatcatttctaataactttaatggatgctgctgctttcttctttttggcccccaagatactcagagataaacttgaaactcaactataggtggggggagggggaagggatagctttaggaaatatacctaatgctaaatgacgagttaatgggtgtagcacaccagcatggcacatgtatacatatgtaactaacctgcacattgtgcacatgtaccctaaaacttaaagtattatgataataat

SEQ ID NO: 28944 - DNA, 835 bp, Homo sapiens
tgttgggggagacagtggataaggcaagaggcactgtacaaaagacagcatgtgaataaagccaaggagacctgaaggagcacaacataatcttgaagaggaagtgggttggttagctgcgatgaaagacatcataaggggaaaagtaatgggagatgaagctggaggtctaagttgacataagatataaagatgaagggcttatacttcagattgaaaataggattttatataaaccaataaaaaggaacaatccacaaggtttttaattagggtagtgacataaccaggtttatgtttggtaacaactcagcaaaagacagaatatggcccagagtacagaaaagtcagaggcagattaattagctaaggagattacttactaccattctctagtcaaggaatgaactaaactagcagcaatgtgcataacacaaagatagaactgagcggacttaggaattaggaaggaaaacaattctatacgatttggtgataggctgactatggaggtaaagaaggggtggaagaggactatgatatttctaacttggggaattggggtagacagggacagcaccatccaagaaagtaaatacaagcaaaagaggtttgtgggagatgttaatgagtaattacataaatactcagtttgaaagacctcagggacttatactgctaaccactcagtctacaacttaatcatatgctgaattattttgatgtgtttaagtagatttctcaaccaatcacaaaacttcgaaaaccttgtattttatttctttcataacatcactagtgtataaaaagccttcattgaggatggtccgcacag

SEQ ID NO: 28945 - DNA, 1402 bp, Homo sapiens
gtctctgcccatccgcgcacccgggcttcggctggagagggccagctcgcttcaggaggccgaaccccgttcccaccaaccctctcagctcagacgcggggtgctgagtcacggggggggggtggttctgtggatagttggaatgcatacacagaggaaagggggatgcggcaccagcagacagagagacaagaccccagccagcccctgtccaggcagcatgatgaactttgaacaggcacataccgccagatcttccatccagagcagctcatcacaggcaaggaagatgctgccaataactatgcctggggccactacaccattgggaaggagttcatcgacctgctactggaccggattcggaagctggctgaccagtgcacaggacttcagggcttcctggtgttccacagccttggtcggggcactggctctgacgtcacctcattcctgatggagtggctttctgttaactatggcaagaaatccaagctgggattctccatctacccagccccccaggtgtctacagccatggtccagccctacaactctatcctgaccacccacaccaccctggagcactcagactgtgccttcatggtggacaacaaagcaatctatgacatctgccaccgcaacctagacattgagcgcccaacctacaccaacctcaatcgcctcattagccaaattgtctcctccatcacagcttctctgcgctttgacggggccctcaatgtggacctgacagagttccagaccaacctggtgtcctacctcacatccacttccccctggccacctatgcaccagtcatctctgcagaaaaagtataccacgagcagctgtcggtggcagagattaccaatgcctgctttgagcctgccaaccagatggtgaagtgtgatccccggcacggcaagtacatggcctgctgcctgctataccatggagatgtggtgcccaaggatgtcaacgctgccattgctgccatcaagaccaagtgcagcattcagtttgtggactggtgccccacaggctttaaggttgatatcaatcaccagcctcccactgtggtgcctgggagtgacctggtaaagtgcaacgtgccatgtgcatgctgagcaacatgacagccatcactatggcctgggcccgcctggaccacaagtttgacctgatgtatgccaagagggcgtttgggcactgatatgtgggtgagggcatggaggagggtgagttctccaaggcccatgaggatatgactgccctggagaaggattacaaggaggtgggcatggatagtgtggagtgtggggaagaaaagataggggggatgaatactaggggaatactgtgtgtctgtcctacataaagtgctgtggccttattgtct

SEQ ID NO: 28946 - DNA, 1297 bp, Homo sapiens
gcgagtataaggaggaggctggctggccgctgcaggcctctcacagatctatccctgctcactatcctgcagcagacagagagacaagaccccagccagcccctgtccaggcagcatgatgaactttgaacaggcacataccgccagatcttccatccagagcagctcatcacaggcaaggaagatgctgccaataactatgcctggggccactacaccattgggaaggagttcatcgacctgctactggaccggattcggaagctggctgaccagtgcacaggacttcagggcttcctggtgttccacagccttggtcggggcactggctctgacgtcacctcattcctgatggagtggctttctgttaactatggcaagaaatccaagctgggattctccatctacccagccccccaggtgtctacagccatggtccagccctacaactctatcctgaccacccacaccaccctggagcactcagactgtgccttcatggtggacaacaaagcaatctatgacatctgccaccgcaacctagacattgagcgcccaacctacaccaacctcaatcgcctcattagccaaattgtctcctccatcacagcttctctgcgctttgacggggccctcaatgtggacctgacagagttccagaccaacctggtgtcctacctcacatccacttccccctggccacctatgcaccagtcatctctgcagaaaaagtataccacgagcagctgtcggtggcagagattaccaatgcctgctttgagcctgccaaccagatggtgaagtgtgatccccggcacggcaagtacatggcctgctgcctgctataccatggagatgtggtgcccaaggatgtcaacgctgccattgctgccatcaagaccaagtgcagcattcagtttgtggactggtgccccacaggctttaaggttgatatcaatcaccagcctcccactgtggtgcctgggagtgacctggtaaagtgcaacgtgccatgtgcatgctgagcaacatgacagccatcactatggcctgggcccgcctggaccacaagtttgacctgatgtatgccaagagggcgtttgggcactgatatgtgggtgagggcatggaggagggtgagttctccaaggcccatgaggatatgactgccctggagaaggattacaaggaggtgggcatggatagtgtggagtgtggggaagaaaagataggggggatgaatactaggggaatactgtgtgtctgtcctacataaagtgctgtggccttattgtct

SEQ ID NO: 28947 - DNA, 646 bp, Homo sapiens
gagagccacccagcgagtataaggaggaggctggctggccgctgcaggcctctcacagatctatccctgctcactatcctgcagcagacagagagacaagaccccagccagcccctgtccaggcagcatggtgagtagaaggggccttggggggactgagcatgcaagtgagggtcccagtgggcccaagatatctggcgtgaaggtaccttgggagtccacatggtgatggggctacagtatgtggcgaggtggggagagggaaagagacttccagatgtggctgtggcccccaaatgtgcaggtgtggggggcatcacagggggtagggaaggaaagtttaatggtaaccaggttgtggggctgagcctaggctgagaagcagggctgctgagggggtctgaatttaggtgtggggagtgtgggggaagcaggacttgagcagaaagtgtaggcgatttcctctgctggctgaggatctccagaccctgggccttgccacaggttcactgttgggctctgatcccaccttcccaccatggggacacatcctccatggaagcttctcccctctggttcctccctccaccctgcccatctgctgtgcctttgtctgacctctcatgtcagttacagatcagtgggg

SEQ ID NO: 28948 - DNA, 361 bp, Homo sapiens
tgagacggagtctcactctgttgcccaggctggagtgcagtggcatgatctcagctgactgcaacctctgccgcccaggttcaagcgattctcctgcctcagactcccgagcacctgggattacaggcacctgccaccgcgcctggctaatttttgtatttttagtagagacagggtttcaccatcttggtcaggctggtctcgaagtcctgatctcgtgatccacctgccttggcttcccaaagtgctgggagagcaagtatgagcccctgtgcccggccaacttttttctataatttaaagtaacagtataggcatacttatcagcatagcaaatattatttatgcatacaataagttc

SEQ ID NO: 28949 - DNA, 461 bp, Homo sapiens
attttatttatttatttgtttttttttttttttgtgcaggaggccagaggaacttgtctggcaattatgagagtggatggaggaactgcctatccctgtcccatggtcttgtccacaggtcagcctcacaaagggaaagagccctggatgggaatacagtggaaggtcattctcttagtgacctggggacattggctcgagaggaagcctggcaggagtggcaactccagatgatttctgtgcctttcctctttcctgggaggtgggccaggccacagtgttagtgggaagggaactgaacagccagagtggttagagggagtgtctagggaaggcctagaggtggaggaagaagctgtgcaggacagggcttgccagtcagaatgaagtgggaggaagatgagggacacagagaagcagagagaggcagatacaccatggcagtgagcagtgagggagac

SEQ ID NO: 28950 - DNA, 387 bp, Homo sapiens
ggggaaagtgaattttgtttttctcctcaagtgcctaggcttggcaaccagcactctctaacattacgttgctcccagaggtggagagttaaagcaaatgtctcccagtgtgtggtggcagacacaaaataatagatccccaaatatcccagagagcttgggcctctactcagttccaaccacgtgtttgactgaataaattatattttatctttactatgagatattatataaccgttaaaaagaatgaattggaggtatgccagctgtcctagaaggtttttcatgagatgttggctgagacaagcaagaagagcgacaagagcgaaactccgtctcacaaaaaaattaagataaaattagcataattaaaattctttgtatcat

SEQ ID NO: 28951 - DNA, 272 bp, Homo sapiens
  misc_feature (268)..(268): n is a, c, g, or t
tgagatagaaagttggcccgggaagctcaaggagggagagcggcagaggggaagactctgcaattctgcttgccccctaccccggcccaggcaagccaccctgcccccggcccccacctgcccgccccgcctgcccttcctcaccccggtgcctgcgggattgctggagagaacgcggcgatggagccgggcaggacccagataaagcttgaccccaggtacacagcagatctttttgggaggtgctgaagaccaatttacgggcatnccct

SEQ ID NO: 28952 - DNA, 374 bp, Homo sapiens
gattccattaataggtagtctatgcaacaaactctactcaattaaagtaaaactaagtatttcttcattgtaccttagtccaggaagaaattaatggaatatggtgtgctaattatcactacctataacatgaggaatataacattgcagaaatttctcataggggcatgccagtgagcaattactttataaaaatattttccttggtgttaagtatttctctgcaacttttttttttttttttttttttttttgagatggagtcttgctctgtcccacccagtctggagtgcaatggtgcgatcttggctcactgcaacctgcgcctcctgggttcaagcaattctcctgcctcagcctcctgagtagctggg

SEQ ID NO: 28953 - DNA, 958 bp, Homo sapiens
  misc_feature (351)..(351): n is a, c, g, or t
cagttgtatagcttctttttgcctgtggacccaatatcagctgcatcctcctaatctcacttttgagtttattttggaaacaaagattggaagaagattttgctctttgttttcatttccattatttagctgatatttttcactcatttttttttactcataattgattccttatctaaggattaaaaagtaatttcctcagctctactcatagtcttgtatcattgtaatgtttttactactgattttttttaaaggcagagatagatgaataaaaataaggatttttacaaactgtgcaaccatggggtaaattacttgacgttgagtcaagaggggatccaatgttcntcacctggaatcacagggagtaggtaatagcacctgactcactgggttgttgtggggatggaatgaagggcattatgtaaagcaattagcaccttgctagaagtagtaagtgctcaatagaaggtagctattattataattgctttatattagattccgtttcagtaggtcaggggtggaggctgagaaccagtaccttgggtgatcctgaagcaacccatttctgctctaggcattattccctatcttttttaatattaataaagtaaaaaagattcatagacctcaaatatgatagtggttatgcttttcacatccagtgattaggaaacacataatggcaaagttgccctgaatgtattaatgctttgaaataaatttgtatcttttagttcagcataatagttatgtttgaaaatagtagtaggtatatgtcacggatattgtatatttagcccaaagacaatgcccatttggtatttaaaatctattttcataatgtatggagagattccttttggaccttgtgcctgccaggtcagaagtcagactacttcattcccaaagaattctgtggaacatgacagatcctttgcaaaaaaaaaaa

SEQ ID NO: 28954 - DNA, 305 bp, Homo sapiens
gtaatgctattttataagtagctggtctattttaggcaagtagttgaattaatagtgagacagtgtgaagacacctaagtgtcttctgtcactcacaggccctggaaggtgctttgacctgtgaatatcactgagacgctggaagccagtgccttttcctacaggaggagaggcaggtgctgcgggattggttgtgtttgcaaagtgatgactgtagctgacgtaagaattatagcctgtctctcatgagaagatagcttttcctttaaagtttttctcatagaacattgattatagaagataag

SEQ ID NO: 28955 - DNA, 332 bp, Homo sapiens
gcctgaggccaaggatggggtttggggtaccccccgaagggaacctaggctcctgtcccggatgggccgaggggatggaaccgcccccacaaccagctcctggggcacgggggagggatgagaagatgacctgaggggaagctcctgcagcctccttccagcctgggggctgcatcaatgtggctggtgagccgcgaactgagacgagggaagaaccgaaccgaggccacccagtaattcccattgtatcccaaaagaatcttgccaaagatggcgatccggtgcccgtagctttgagaagcagtaataacacaggctttgggaagccagca

SEQ ID NO: 28956 - DNA, 401 bp, Homo sapiens
atcacagcacactgacttctctgcaagaactcggaaagttagaagacaatgaagaaatgtctttaaagttctgagggaaatgatttctagaatcctctacgcagccatgttattaaccaaaagtgggagagaatacacttcagcaaaatgtggccaacatcccagccagaggacgggacaggaatgagggtggcctggatggcagcgacacagagagcccagactagagctggcagggaggaccttccagcggatggtcaggacccgggttctggccatgctctcagaaactgcgaggctgaattacaatcctagaaactaagcgaaatgcaaaacaaacaaaaaaaacaaacttgaagcaatttttaatttcaaggaaaacataaagttgtccaagaaag

SEQ ID NO: 28957 - DNA, 307 bp, Homo sapiens
gattcaaaccatagacttagactttgaaggccatctttttaacatggttccgtactgcaacctagaattattcttgccttttaaatgatagtatttcattctgaaataatcttcggctgatgctccattcttttgtgccaattcatgttcaaagacagtaattcccattatgtatgattgttcacgttgattctcatcccagcttggctgcttattagattggtgaccttggactagtgatttaatctctcaacaaatccatgtcctcatcttcaaataaaaattacagtatcttcggctgggtatg

SEQ ID NO: 28958 - DNA, 458 bp, Homo sapiens
aatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaagcctggctaacacagtgaaaccccgtctctactaaaatgcaaaaaaaaaaaaaaattagctgagcatgatggcgggcacctgtagttccagctactcgggaggctgaggcaggagaggcgcttgaactcgggaggtggaggttgcagtgagccaatattgtgccgctgcactccagcccgggtgacaatgagaggctctgtttcaaa

SEQ ID NO: 28959 - DNA, 776 bp, Homo sapiens
cacacacctgaaaccttggaaaacgatttgaagcttagaggttgaggtcaagtttaatacccaagtcaccgagaaggtggctttgctttttcagaggcctttgcttttcactgttgcaattgtgtgccatgcgtcgtctgggaatcagtgagtgcccgtggagtgaagtcccaatttctgggtgccttctggatgctttgtaaagaaaggtgttaggatacgttgtctacttgaaaattgcaggctgggcacagtggctcatacctgtaatcctagcactttgggaggctgaggtggatggatcacttggggtcaggagtttgagaccagcctggccaatatggtgaaaccctgtctctactaaaaatacaaaaattacctgggcatggtagtgcacgcctgtaatcccagctactcgggagtctgaggcaggagaatcgcttgaacctgggaggcggaggttgtagtgagccgagattgtgccactgcattccagcctgggcaacagagtgagactccatctcaaaaaaaaaaaaaaatttaaaaatttaaaaaaaagaaaattgctaagagattagattttaagtgttctcaccaaaaaaaaaaaaaagcctaaaataggtttatgaagtaatgcatatgtgaattagcttgatttagccattccactaagtgtaccaaaacatcacgttgtatgccataaatatatacaacttccatttgttaatttagacaattattttatttataaatttttaaaagaaatgcgttaggta

SEQ ID NO: 28960 - DNA, 470 bp, Homo sapiens
ggacttccgtaataaaagggaataaattactgacttgctgcaacacggatgagttcaaaaacattatactaaagaaaagaagccagatacaaaaaccacatatgaggtgattctatttgtacgaaatgtccagaaaaggcaaatctacagagacagaaagtaaattagtggttgcccagcactggagtgggaatagagatggtaagtgaacatgagggttattttcagagtgatagaaatgttctaaaattggttgttattatgatcaaacaaccttgtaaatttactaaaaattgttaacttgtacaatcataagaagtgaattttctgatttgtatattacacctcaatgaaaattttaagcatagtaaatgaacatcattccaagtatttttttctctgcttatacagaatgagagcaatagataaccttttaaaatgtgttcatatgaatgctactaattttagtc

SEQ ID NO: 28961 - DNA, 428 bp, Homo sapiens
ttttttgtttgtctgtttgtttgtttgtttgtttggagacggagtctcactctatcgcccaggctggagtgcagtgacatgatctcggctcactgcaagctccgcctcccaggttcacaccattctcctgcctcagcctcccgagtagctgggactacaggcacccgccaccatgcccggctaattttttgtatttttagtagagacaaggtttcaccatgttatccaggatggtctcgatctcctgacctcatgatccgcctgcctcagcctcccaaagtgctgagattacaggtgtgagccaccgcgcctggcccgcactcaccctgcttcttaactttttctgtcatcaggaaaatgagccacctggctcaagaagaaaaaaaaaaatctttgcttcaagcttccagtatctgactatgcaggat

SEQ ID NO: 28962 - DNA, 854 bp, Homo sapiens
cttgctgcctgtgtttggagctaattatttttggagaggaagaggggcagtgagacagccagcctgggcatgtggggaccaccacaaccacctcccccatgcactgacctatgaggcatgcagcaatgataaatggccctgatgacaaagcaggacagaggcctggcagtgtgatgctcaccactcctgcctgtcaactccaggctgaagatgccaaccccgttatgacagactcacttgccagcctgtgccatttgtattcctcatggcagttactcagtagctggcatttataggtctataaagaatataaggttatgaaaaacctgcttctaattttccatgcttttccctacgtcccatgttacagttgcccccccaaataatcagccaccagggtgcatggcctattaacagtcctgaggtgcacacttcaattaaagttctctctgccttcagtttaaatccctagccccttccacttaccagctgtgtgacttttggaaagttcttaatctttctgtgccttaatttctaattagtaaagtgggagtataataggaccctcctcatagggatgatatgaggattgaatgggttaataggaagcatgtaaaacagtatgtggtctctggtgagggcacttaagtgttggctgtaattatgttactattaatttgtgagttgagatttgaaggataaaaagatgcagccacagattcttacagacactaactctgtaaaccgataggaaaaacatcggcattaaaggagagtcattaacattaagtggaagaatgtccacttcttccctgcctgccctctccctgaaataaagaacagcttgacagaaa

SEQ ID NO: 28963 - DNA, 350 bp, Homo sapiens
taacattaacagctttattgtcagtagagccagaatacagaacacattgtaacctggacctgcaatcacaatcaagcttgctgccttcttcccggaatctagaccttgcaatgcatctgctgggtcgagtatttggcaaggcagatacttacttatctatttaggcagcctaccaaaagaaaaattgcttacccctcacttgtcaagcctcaagtgttgggaaagaatagtgtcacatgcaattggtttttaatacaggtattgcactcacttaagaaatggaaacaggctgggcacggtggctcacacctgcaatcccagcactttgggaggctgagatgggaggattg

SEQ ID NO: 28964 - DNA, 442 bp, Homo sapiens
taatagcagaatatttcatggccgaactcttgatagtgacaaatcagtaaatacaaccaagaaaaagaaaatgaggggtcagagttgcaataccccaaatgaaaaataacagttttttcagggctttttggtaccagaactcaggcacttggattttatgaccttatactttttctgcatctctctaaaacttgtgttttcagaccatcctgtgtatagagcaggagagtttctactgcaagtgacaatcagaggtgactatctatatttgcacttaaaatcaaagtagttcaacatgcaaatgctagggtctagccctgggtaagggccatgctggtgtactgtgttgtgatgatggaagcagtaaatcaaaattatggaaatttgcactgttgaaaagcatgctttagctttattttcaattaaaaacactgtttaaaat

SEQ ID NO: 28965 - DNA, 837 bp, Homo sapiens
tgattaaggtggattaaactgaaagaagtggtgggcgtctgaattggaattagaattaaatattaatagaaacagtagcatccactgcccttcacacacaccttcctgcccacttaccatcaggtgaagtaagctttagggatggtacatttattcagagagcaccttgcacaagcccagcagagtgcccagtgtggtgccaagagccgaatgaccagagatggttccagggggactgattcttcagacagggttctaaggacaaagggcaaaagccttccccgggaacacatgctgatggacatgttcagcccctcctgaggttcggggttaacgcgaaccaggtagaagtaatgtgtgccagggacaagagacgcacccagagcctctggcctttggtttcctattcctgggttcacaagcacattccaagtttgggactgtgtgttgggcaggtgagacctttataaggttcccatggctgtttctgcgtgagttggctgaataggaaatcaaaggacttctgtgctgttccgcagagcagggccctagttaaaattcctcacagatgatgctgactaggatggaatccctttgcctagtgcttaagagtacccaggtctggaattgagcttagtcaggtatgagcctggacaagtaactgtatctctcaaagcctgtttcctcagctgtaaagtgggggtgataatagtaggaaccccaggattggaattgctgtgagaattagagatgatgtgtaaaatgctcagcacagtgtttgggccaaagtaagctaactaccaaaacccagccatttataaaaacccaaccatcata

SEQ ID NO: 28966 - DNA, 505 bp, Homo sapiens
ggaactctgatagtctgacagcaccatctggacttggcagggatgacagccctgagatcagatggaactaaccaataaagctgctaaaattctgctgtcctgggcctatccggagtgggactcccgtaatctcctatttagaaggaacactgatctgcaaggggagagctggggcccttaatcattctgcagagctgataacggtcactgtggaggcaggactaggcgggtgcctggtttgcttagtcccaccttgaggtcccgagttccagtggtgtgccgaagtggtttgcactggcccatgagagtggattgttgaatttccaggaattttgtaagctggttggtaaacacagccacagtgaccattagagattatattaacctgcaattaaataaagtatgttaaaaacagtaataaatactcaaaactcatcacttcctaattattttactattatctatgttcttgaggatactgacatctattgtattggtatggtgt

SEQ ID NO: 28967 - DNA, 447 bp, Homo sapiens
gcaatgctaacatatatacatataaatccttaatatcatttttatttgtaagattatgttttaagcaaagtatattaaatattcattcataaggatagagtaaaagaagttatagttcatccctatggtacataaaatacattcccacatctctccaaataatactgggtgtctttatatggttgacatataaagatgttcctagtatatgttaattgagacaagcaggttgtaaaatgaccttctcttcccattcttctcatgttgtcctcaaaaaagatatacttcttttctttcttttttctttttctttttttgagatagacagactctctctgtcacccaggctggagtgctgtggcgtgatctcagcttactgcaaactctgcctcccaggttcaagagattctcctgcctctgcctcccgagtagctgggattgcaggtg

SEQ ID NO: 28968 - DNA, 1642 bp, Homo sapiens
tagttaaaaaagtaagccatgcaactgagataaaagtcaaagttatagattataactgtttgcacaactgttcacatttttaactttttttattttttggagactttttaagagtctcactgtgtcatccaggctggaatacacagtggcactatcatggctcaccacacccttaaactgcagggctcaagcaatcctcctgcctcagccccccaagtagctgggaccacagatgtggaccaccacccctggctacttttttaaaaatttttttgtagagacaatgggctcactatgtttcccaagctagagacaatggcctcattatgtttcccaggctggtctcgaactcctggcctcaagcgatcctcctgcctcagccttcctgaagtcctaggattacatgcatgagctaccacacccagcccctgctcacattttatatagtaacttattttaagaatagtaaagtatttgcaaaatagttttttaatacagtaatttattatatattgaaatcaagcttgatgatatttcattaggttttgctgagtgtcatatgctaagttatttgcttatgaatttttctccaattgcctgtatttggtaagtttgcatggaaagttctgacaggaaactcagaaatatttcattgttttaccctactatcttttttgatgtgtcttaaagttgatttgctttaaattgcagtatcatcctttttttctgtacctaaatgtttttaactgaagaacacaatttccctcaaaaccctcatccctaatttagagccctcttatattaatatgagtcattttaaatgtatttcctgaaacacttctcaacttcgtaaataaaaaagagatatatcttagtccattcaggctactataacaaaatagcacaattgggtggcttataaacaacataaatttatttatcatagttctagagcctgggaagtccaagagctgggtgccagcatggttgggttctgatgaggatcctcttccagattacagacttccagcttcttgctgtgtcctcacatggtggaaggaacaagtaatctctctggagcctcttttaaaagcccaccaatcccattcattgaggattccaccccagtgacctaatcacttcccaaagggccatctcctaatgctataaccttagaggttagggtttcaacatatgaattttgaggggacagaaacattcagcccatagcaggatgagaaaaagaaaggaaagtacaacaaagaacatcaaccataaggaacaccatgacttctgatatttaatatcatggatcacagattgtaggagtcgagaaacagaataaaaagacaaggcccaggcccagtgagcttttgatgcttgaggctcctcatgcccttgctctcccactgacctcagtgctcagcactggctttcttctcctggtgatattttccatttatcttttggtgtaaacattttagagatgagagaagtagggagcttatcattatttagtctgatcagacaatatcttcacttttaagttatgttcagaatttcattgtcctgttctttttaagaatcatatgagattatttttgtgtatgtgaataaactatgaagcattttcttacaaaaa

SEQ ID NO: 28969 - DNA, 424 bp, Homo sapiens
tctcactcgctctccagcatgcccatccttatccgctcacacattcacacacatgtatgcacgcacgcaactaccctgtgctgtgccagacagcagttactctggctcagcttatgtttttcgtcatgctgttctgagaaaaaagagaatatgtttggagagaccccagctgccagacagcagtgcttttcttccccccctaattttggccccataagtcagatctcaattttctttaccccttgagcagtgaaagagaaaggggcacacaccacaaaccagaaatgagacagaagcctggtgcagtggtgtgcacctgcagtcccgaatactcaggaggccgaggctggaggattgcttgaggccaggagtttgagtccagtctggacaacatagcgagaccttgtctctaaaaaaaaaactt

SEQ ID NO: 28970 - DNA, 542 bp, Homo sapiens
cttctctgtaaggggccggtgggggaaagctaaatccacctccagcaccccctgcgagatcacctaccacagagctttcaagcaagagccagcaggccacagcctggaccccgacgcagcagcctggaggtcaactgcgaaatggaagcctgcacatcattgatgacttcgagtctaaattcacgttccattctgtggaagactttccccctccggatgaatataaaccatgccagaagatttaccccagcaagatccccagaagccgtacacctggtccctggctccaagcggaagcagtcgggcagagctctgatgacatcaaaggcagaaattctcagttatctctaaagactcttcggtgagaagacagatgaagcgaaggtcctggggttccaggttgcagaacaacatgtcagaccccacccaccccatgctcaagctgtaattcagttggcatacaggcttggaattgagaatttatttattgtaaatatgtgatttgcacgggctttaaagcagtattttaattgacttttatt

SEQ ID NO: 28971 - DNA, 502 bp, Homo sapiens
ctaatgctaccctcataaaacgagaagtcttctctcctccttgattttctgaaggaatttatgtaggactggaatggtttattccttgagtttcaatgaaattaatcagtgaagccatctgagccacaagttttctatgtgggaaagtttataattattaatttttctttttaacgtaaggtttttcaggttttctatttctcattgtgtcagtttggtcatttgtgtcttttaagcgattagcctatttagcttaaattgttgaatttattgacatgtacttgttcataatacagtcatcccttagtataaggattggttccaggaccccctgaggataccaaaatctgcggaaatggtcaagtcccttatataaaatgatgtacatgtgcatataagctacatacactccattgtatactttaatttctagattgcttataatatctaatacaatgtaaatattgcttataatacataatacaaagttattatactcttt

SEQ ID NO: 28972 - DNA, 368 bp, Homo sapiens
gacacccaactgccaacaccttcaacttgatcttctggcctccagaattatgagaaaataaatttctgttgttaaagccacccagtctatactccttttttatggcagccctagcagaccaatataccgtgtgtctggggcagtgcctctaaccaagcccaaaatttctacagggaaatatattaattttcatagtaagtgggataaataaaatccataaatagcttcatggtagttcaggtcaagatactaagtttccaacacacagtataagagttatgcccaagagtctgtaatcccctcccctcccctgccctcccctccccttcccgagacagcctggcaacagcgcagactctgtctcggga

SEQ ID NO: 28973 - DNA, 168 bp, Homo sapiens
agtttctcaaaacatgctacatacctagtaaaattcatgcaattctaaatagataaataaatttagtctaaatgaagtcagtgatgccaatataatttttaaggtagcatcattgaaataataaaatctgggaaattctaatgcttctaattgaagactagaaggatt

SEQ ID NO: 28974 - DNA, 568 bp, Homo sapiens
tccggagtagctgggattacaagcgtgggctaccaggcctagctaatttttgtatttttagcagagtcagggtttcaccatgttggtcaggctggtctcgaactcctgtgctcaagcaatctgcccgcctcagcctcccaaagtgcggagattacaggcgtgagccaccgtgcctggccaatttttaaagaaatcaaacatttaaatgaagccagagtcctcgttcatcactacccttatcctgtcctgcccactcaggcagtaaccaccctcacaccaaggagaattttccttccagcacattcttacacattttttatggagatctgtctatctacatacaacataaagttttgtacagttttcatggtttcatatggtgtagagtgctggacatttttcctccttgacatattgtttttgagatacattatttgtacaggttgagccaatgatttgtaactgctacatgcagaggattatttcctcctataactgtaacataggtgttcatctatttcccaatggagctcgagctggcttatttcctaagcttttactgacataa

SEQ ID NO: 28975 - DNA, 413 bp, Homo sapiens
ctgctgcatttaaagtagtggacttagagactacaaaagatgggagagtgggggggcggtggtgagggttgaaaaatgacccttgagtacaatgattgctgtttgggttatgggtgcactaaaagcccagacttcacctctatgcactatatgcatataagaaatccatacttataccccctaaatatatgtaaaaaaaaaagtagtagactttagattattcattaaggcataaaatagctttccttttgtctttatagtaatccttagactgtgtgtgtgtgtgtgtgtgtgtgtgtttgtagaagcaaatgtatatatatacacacatatatatgtgtttatatatgatttgtaatggatttatgatgactaataaaatatatataaatatatgttccatgatttggcaa

SEQ ID NO: 28976 - DNA, 869 bp, Homo sapiens
atatcacgtcatgtctgggtatgcctttctcctccctcctaggagtttgcctggttctcactccctcaaagtactctatgatcaagtttctttggatccatgtttattgcacagtcaaatctgttgatattaatcacgacatgttagttgatcagggaagactcatttttttctagatttaggattgttatccggctgtgtccactgtttaatggtgatgtttgtaattctgtgtgcctagcaaggtctgtaggatcaaactacaaacttctggtagtatgtgtagcactatgcaaatacaaggtagtaataatgctgttactgtcactgtccttgagacatatcttgtgaatttcaggggattaagacagatgactgaaaagttgataatctgttgaataaatctttaatttagagcttgctctgtgctatgtaatgaaaaaaagacaacgaagatatagggggtccttggtttagtctgagtattattttagtggagccacatcttaagtaagttcagctatagagatttagttaatagaaataagatggtggttgaaagagaagtctgattttacagcagaatagtatagtaatttcctgctctgagtccatgccagaatgccctggagtgagaatgaggtgtgtgggagtcatgaatctgctttttccttgtgcactcaatttttctgccactgatgttgggtcagtcttgctgttgtgaatattttgggtaaagcatggctcctaagtataacaaaaggaaggcataaaaggaaagctggctgcatagacagtttattgagagaagatgttagagtactgaactttacaggggacttcaggaatttttgagggaaagatccttt

SEQ ID NO: 28977 - DNA, 759 bp, Homo sapiens
tgaggagtgtgtgtatttatgtgtgttttgtgtttatgtataaaattatgtatatatatgtacatatgtgtgtacatctatcttaatgtgtatatataaatatatatctatagctgtacatatgtatacacccataaacaaagctcatagtttaaaactttggaattttcagtttggagaacttattattattacaatttatatttggtttcctagacggtctaatatagttctaatttccaaaattctcttccactaaaagtggatatatttatttatggtgccgagaacattaacaaaatatttagatttaatatctatgaataataaaccaaaaaaagtgcatttaaggaaacaccaaacttgtaaaaactggctctcttatccaaaccatttgttggaatttcaaactacatgttttcacacttcttcattccaaaaaaaaaaaaaaaaccaaaccagaaaaaacccaaaacactaccaaatgaacagtgataatgtttaagaagaaaaagaaaaatgtaggtgtatgatagcacaaattcaatggttattgccctagtggtgcttcacttacctattggttaatttattatatcctggttaatttcactttatcactgatgagggttcctgtgtccctacatgatttatcggtggagctaattatctatttatttaaagctatagtaaataatttataatatgcatattgtaaatagatactaaaagtcatgggcacattgtaataatcacaaa

SEQ ID NO: 28978 - DNA, 464 bp, Homo sapiens
gccactggtaattcaccatatttacagaatgaagaagaaagatcatatcatttcaatagatacagaaaaagcatttgcaaatgtcaaaacccttttataacaagcactcttagcaaactaggagaagaaggaaaatccttgaacctgatgagggagtctctcaaaagctaccagatgacatcctgctcgatggggagctgctgggcgttttcctcctgtgaccaggaaggggcgcctgccctcaccactgccacccagtctcattcaacacagagtttgtcccctgttagaaaccgagacgttggttacacgtggaggttgggagtggctcaggcaggcagaggggcttctgggaacctggccatgttccctttcagtctgggcgctacttagagcagggggcagttgcttcaataaaactttagattcccacacaggccaggcgtggtgctcacacctgtaat

SEQ ID NO: 28979 - DNA, 224 bp, Homo sapiens
gtaaaatattcctaaattttcatatggtcactacttaatgcagtgattaataataatttcttctaaatccatgctttggcagccaccctaaaacccaactgatgtgagtgaacaactaagcttaccatctgcctacctacctgtctgtctatatagagagagaaagcaacctatagtcacttaagtgacataatgtatgaaagaattcctataccgtggctgtt

SEQ ID NO: 28980 - DNA, 274 bp, Homo sapiens
cttccattcaagatctatgaagaagatccagatgaccagaaccagtgattcccatgctttatctgcaatatgtcattctttatttccctagctattttctctcctctttgttaaagtttctgattgctaacagaaagttattatttcttaaacataatatctgtacggttcccatccttaataatatttcggcatgtttacatacttcttggcctgattccaatacctgccagcagttttattgcaatttggctaaagaatacaatcaaactga

SEQ ID NO: 28981 - DNA, 649 bp, Homo sapiens
atatagaattccattcaatgatttttgcaatttgatcagcttgaagatgtggataaaggaaatcttcaaaaataaaactgtctagtgaagataaaagcatataatgtaggatctgcagcagcagccatcattagctattgctcttccctacgaactgaaaaaaagctgcagacttccataccaactgacagaatgattgcttccatcccaagcctctgtggtgcagatgtaaatagtaaagtcatgtaaatagcattaagggaaaatttcaacattctctacatttatcacatttcctcattttagagaattcatgagtattaaatgggttattatgaaaaatgttcattctcagtgatcatcagagtgtggcgaaattcatggtgatgagattaatgtctgttacctctgttttttccacaagtgcaccactgagctttagtgtacatttttcttgtttgttttcctctttgccattccactccagtcacacaggcttcctgcaatcatctattcaatatgcctggacagaggtatatgatgtccagttttctatgacccaacgtcagcattgggaaaccagttatggcgatgctgagcagagagagggattcatgcaggtaacccagattaggacaccccctttcaa

SEQ ID NO: 28982 - DNA, 710 bp, Homo sapiens
caaataagaaagactgaaatggtagatttcaaattttatacttaaaagctataattaatatagaaatattttgtttttattttagacagtcttttcacagaaaaaattagtatttagaagttgggatctcgcataggtatgagtagaactgacttacataaagtaatccttaattttttatgagtttagccattttttatacattgcatcattattgccgtattttctaaattatgaactgcatatatttgctttcaaagaagtaatcattatgtgtttgagtagtatagatagctcttcccaggtatcaatagccaaatttgacatgatactgtaatttactagcctttttagaggaaatataatgtgtagacagagcttttaaattatttcccctgtatttaatttggctttttattcctgttgttttaaagtatatgatgctataattccagattatttgagagtgtataacttaatgggataacttgctcagaaatgtttttggtcacatagttttgtttatctggaaacttgtgagatttaaaaattttcggctggatatggtggttcctacctataatactggtgatttgggaggctgaggtgggggaattgcttgagcccaggagcttgaggctggagtaagctatgactgtgctactgcactccagcctaggccacagagcgagactccatctctttaaaga

SEQ ID NO: 28983 - DNA, 384 bp, Homo sapiens
gttcaagcaattctcctgcctcagcctcccaagtagctgggattacagacatgtgccaccataccgggctaatttttgtatttttaatagagacagagtttcaccatgttggccaggctggtctcaaactccttacctcgtcatccacccaccttggcctcccaaagtgctgggattacaggcatgagccaccgtgcccggcctaaaatgttttcttctactgagtaggccccagaactaaggctgaggtgatcatgtggggagggactgcaagcaggggtaaggacaatgcaccaggtaccacttgtcattgttttgtgagctgcttgtgtatataatggttatcagtctttatttattaccccaaactgactcctgaaatac

SEQ ID NO: 28984 - DNA, 680 bp, Homo sapiens
gttgcatttagcaaatgtttgctaattgtgaggctaaatcgtctcgcttcccagtgattagagaagcctgggcttcccagtgcccaggaaaccaaggagagttcccaaaccctcacgtatcctttgagtaacttgccaacttggggtgatgaaaacgcactcccctcctcccgccgccgctgggtcgggctctgaacgcacgagcctcggagctatgaggtcatacacgggtcacgtggccgctgtcgcatctgtcaactgtgatacaattactaagactgtccggacattcaaacctgctctctcctcctcctccctctccggtacgccggcccttttcacaccaagggaccgtctcaaaagtctaggctccaaatgctacgacgtaagaaaggaggagaaagagggaggaaaaaagtcgaagactacacttctcgttgctgccgtttgaaaactatgcctaagccccgttatttaaaatcctttctgccaaagcaagttggcatatgtattaagagccttttaaaaatcgtcatattctttaactcattaattcctgttctaggatgcttgcatatggaaatagtccaaactagagcaaaggtttacaaaattcactctcttattattaaactaactatatatgatgagaatgaataaatcaggtataaaaaaaaata

SEQ ID NO: 28985 - DNA, 439 bp, Homo sapiens
gctttttttcactgagcgtaattttctggagatccatacaacttgtgactaacagtagtttgttcctttgcatttgtgtatagtattccatgatgtgatgtactgcagcttgttgaaccattcattcattgaagaccatttgggctgttcgagtttttgcatcacaaataaagctgctatgaacatttgagtacaggtttttgtgtgagcttagttttcatttctctgagataaatgccctggaatacgtttgctgggatgttttgttttgtaagacactggccagactgttttctacaatggctggaacattttatatttacaccagcaacgtacaaggtccagtttctctgcatcctcaccgatgtttgatgtttatcactatttttttattttagcaattctgatgggtatgtactgatactttattgcggctctc

SEQ ID NO: 28986 - DNA, 2765 bp, Homo sapiens
ctaggcctcagtctgtctgcatccaggtgcttattaaaacagtgtgttgctccacaccgcctcgtgttgtctgttggcgcgctctccgggttccaaccaatgcaagagccttggggctggccctgaaacctgcgaggggcttccgtccacgtccccagtggacctaccacccctccatctgggaaagcaggccacagcagccggacaaaggaagctcctcagcctctagtcgcctctctgtgcatgcacatcggtcactgatctcgcctactggcacagacgtgtttatcggccaaactgaccctcacaaaaagctaccaccgaagtggacaggcccctacactgtgatactcagcacaccaactgcagtgagagtccgaggactccccaactggatccatcgcaccagggtcaagctcacccccaaggcagcttcttcctccaaaacattaacagctaagtgtttgtctgggccaatttctcctaccaagtttaaattaaccaacatttttttcttaaaaccaaaacacaaggaagactaaccacgtgcttccaggaatggcctgtatctacccaaccactttctatacctctcttccaaccaaaagtcttaatatgggaatatccctcaccacgatcctaatactgtcagtagctgtcctgctgtccacagcagcccctccgagctgccgtgagtgttatcagtctttgcactacagaggggagatgcaacaatactttacttaccatactcatatagaaagatcctgttatggaaacttaatcgaggaatgtgttgaatcaggaaagagttattataaagtaaagaatctaggagtatgtggcagtcgtaatggggctatttgccccagagggaagcagtggctttgcttcaccaaaattggacaatggggagtaaacactcaggtgcttgaggacataaagagagaacagattatagccaaagccaaagcctcaaaaccaacaactccccctgaaaatcgcccgcggcatttccattcctttatacaaaaactataagcagatgcatcccttcctaagccaggaaaaaatctgtttgtagatctaggagaaccattgtgcttaccatgaatgtgtccaattgttgggtatgcgggggagctttatgagtgaacagtggctgtgggacgggatagacattcccccttacttacaggcatcccaaaaccccagactcactttcactcctcaggaatgcccgcagtcctggacacttaccaacccagtatgagggacggtgtgcatatcccgcaagtggactgataaaacccatcgcgccgtaggtgaaaacccgtcaccaaaccctaacagtcaatgcctccatagctgagtggtggccaaggttaccccctggagcctggtctccttctaacttaagctacctcaattgtgtcttgtcaaaaaaggcctggtactgtacgaacaccactaacccttatgccgcatacctccgcctaagtgtactatgcgacaatcctaggaacaccagctgacaatggactgccactgacggattcctgtggatatggggaacccaggcttactcacagctaccttatcactggcaaggtacttgcttcctaggcacaattcaacctggattctttttacttccgaagcaggcgggcaacaccctcagagtccctgtgtatgataaccagagaaaaatgatccttggaggtaggagggagccaaagattgtgagaggacgagtggcctctgcaacggatcattgaatactatggtcctgccacttgggcagaggatggttcatggggttatcgcactcccatatatatgccaaatagagcgattagactacaagctgttctagagataatcactaaccaaactgcctcagccctagaaatgctcgcgcaacaacaaaaccaaatgcgcgcggcaatttatcaaaacaggctggccctagactacttattagcagaagagggtgcgggctgtggtaagtttaacatctccaattgctgtcttaacataggcaataatggagaagaggttctggaaatcgcttcaaacatcagaaaagtagcccgtgtaccagtccaaacctgggagggatgggacccagcaaaccttctaggagggtggttctctaatttaggaggatttaaaatgctggtggggacagtcattttcatcactggggtcctcctgtttctcccctgtggtatcccattaaaactcttgttgaaactacagttaacctcctgacaatccagatgatgctcctgctacagcggcacgatggataccaacccgtctctcaagaataccccaaaaattaagtttttctttttccaaggtgcccacgccacccctatgtcacgcctgaagtagttattgagaaagtcgtccctttccccttttctataaccaaatagacaggaatggaagattctcctcggggcctgaaagcttgcgggatgaataactcctcctcctcaggcccagtcccaaggtacaaacttgcaccagcagcaagatagcagaggcaggaagagagctggctggaagacacgtaccccctgaagatcaagagggaggtcgccctggtactacatagcagtcacgttaggctgggacaattcctgtttacagaggactataaaacccctgccccatcctcacttggggctgatgccattttaggcctcagcctgtctgcatgcaggcgctcattaaaacagcatgttgctccacac

SEQ ID NO: 28987 - DNA, 609 bp, Homo sapiens
aaaggaaagtcactccatggacaccagtgctccagaggtgcagaaaaattccagatttgtgaaaacgctaagaaaaaatggtgaagtctttttgtgggacatagaatgtaggtggcgggctgggagaggccatggaagtgcctggcacagccactgtcaagaatagagcagcaggaaaattctttcataaagatgtacagatcagaagctaactttatttcagacagagcagcagggaagtttgcagatagctggaagctcactccaaatagcagagaacaagtatgaggcagccattgtaaaccaaagtagaaaatctaagcaaaatctaacacagtaaattatcgttccaaatattaatatcataactttaaaaaaatgtttaacagctttattgggatatgattcacatattatacaattcaacccattaaagcatataattcaatggttgttagtatattcacagaattctgctattatcaccacaatcaattttagaacatttttatcactcctgaaagaaatccatatccattggtggtcattttccattccctcccaattcccacagtcctaagcaaccaagaatctactttctgcctctgc

SEQ ID NO: 28988 - DNA, 424 bp, Homo sapiens
tgagtatcagaagtgaaatttaacttcacacagttatgtgacaagactgtgctataaaaccatgactaaatccaaactgatccataggagggtaaaatgtccgttttcttcattaaaacttctcagctcaaatttatactaaagcatatccaggaattaaaaaaaaaggttttgatgatatttgctttctagtttaataagttttaatactgaataggttaaattaatacaaaataacataaaatgctaatatttattgagtatttactttgtacccactacgattttaagtaatttactgggattattttattttagtttaacaatgcaggtagctactataatcgtccctattttacacttgaggaaacaggctaagagagattaaattagtggcccaaggtcagaaagctcgtaattcttg

SEQ ID NO: 28989 - DNA, 963 bp, Homo sapiens
atgcttttatgtttcagatttgggaaccaatccatgaaaagagagaactttactctcatcactgactttgttttccaaggtttctctagcttccatgagcagcagatcaccctttttggcgtgttccttgcactatacatcttaaccttagcaggcaatatcatcattgtgaccatcatccgaattgatcttcatcttcacacacccatgtacttcttcctgagcatgctgtccacttcagagactgtatatacattggtcattctcccaagaatgctctccagcctcgtaggtatgagccagcccatgtcattggcagggtgtgccacacagatgttcttttttgtaacctttggcatcactaactgcttcctgctcacagcaatgggatatgaccgctatgtggccatctgcaaccccctgagatacatggttattatgaacaagaggctgcgtatccaacttgtcctgggggcctgcagcattgggctgattgtagcaataacgcaagtgacatctgtattcaggttacccttctgtgctagaaaggtgccccacttcttctgtgacatccgccctgtgatgaagctctcctgcattgacaccactgtcaatgaaatcctgactttgattatcagtgtgctggtgcttgttgtacctatgggtctggttttcatttcttatgttctcattatctctacaatcctcaagattgcttcagttgagggccggaagaaggcttttgccacctgtgcatcccacctcactgtggtcattgtccactacagctgtgcctccattgcctacctcaagcccaagtcagagaacaccagagaacatgaccagctgatctcggtgacctacactgtcatcactcccctactgaaccctgtggtatacaccctgagaaataaagaggtcaaagatgctctgtgcagggctgttggtgggaagttttcctga

SEQ ID NO: 28990 - DNA, 1091 bp, Homo sapiens
ccgcgtggtctaatggattgggaaggtttctttatcctgttgtactcctgactccttgtgtaatcatgggcaagtaactctttggaatttcaaagtctctgaggtgtctagtggtaatcagtaacgtgatggttacctatagagagttgctatgagtgccagtgaatgagctgaatttctgaaaaatgagacattggttgctttgtgtattttaatcttgtaacatttatttcaattttgatagctttatctttgttgatcttactaacaaattaatatgaaacatcatgtatactcattatgcctgcctttttttgggaagtagttgcactgatgtgtatagtgagtacacagttagattcattaagaaattacaatttctgcagtttgctgagggttggtgttagaataaagggtgaaaatgtatatagcaaaatattttaaagattggattaatcttggacttctatattatagttactatgaaagtgatttatataatatttgaaaaaatgtctttcatctttggaagaactataaatgtacatctatttctttagttttaattctttaatactatttagtcttgaagctaagtactcagccagtatttcaggaagttagaaataaagcttatgggtgttaaaataggcacataatacagagtcatgtacactgctaggtagaaacttctgaatgtgcttccattacaaaattttggtctttatctaatgatgtgctgatccataatgtttgtatacttataaatgtgttaataacttaaataacttttaaaaagtgaatcttttactgactcaattggttttcccctaaaataatttcttctggtatttgcagtcttgtaggcagttaacagactttaataactttaaaatgtttagtagcaccttgaaaaaaggcttcaactttatattttatgtaagatatactttgggaagcaaattattttgataaattatgagataaagatatgttcagaccaaattttaaattatagataaaagtagcacttaaaggaaaagattcatttgtatagaattactgaagaatatttgatgctagtatcaact

SEQ ID NO: 28991 - DNA, 555 bp, Homo sapiens
ccgcgtggtctaatggattgggaaggtttctttatcctgttgtactcctgactccttgtgtaatcatgggcaagtaactctttggaatttcaaagtctctgaggtgtctagtggtaatcagtaacgtgatggttacctatagagagttgctatgagtgccagtgaatgagctgaatttctgaaaaatgagacattggttgctttgtgtattttaatcttgtaacatttatttcaattttgatagctttatctttgttgatcttactaacaaattaatatgaaacatcatgtatactcattatgcctgcctttttttgggaagtagttgcactgatgtgtatagtgagtacacagttagattcattaagaaattacaatttctgcagtttgctgagggttggtgttagaataaagggtgaaaatgtatatagcaaaatgacttgtgaatgtgaatgtcttatattgtagactaagcataaataaatgtgagattatagctacagacagatgccgttttagaatgatgtagtactatacgtggatcctctagatcac

SEQ ID NO: 28992 - DNA, 470 bp, Homo sapiens
gtccaagaaagaggactgtactttagagcacaatttaggagtaaaccagtcattcttaagtacacaaagaaaacaggtaaaaatgtttgaggcaaaaccatgcctcttaaaagactgtaaacaaaatcaactgaaacaatagaacaaagatcagaatcagctgggtatggctatcggcagcttcgggcttagtcttaagtggcgtccggaatgaagagaagagtctgtggcaacacatctttagatagggagctcaatccctgtggctctgtggcttctttgtagcttggtagtttctatgtaagtctggcacaaggaatcaaagaaagtcagtatcaccaacttctgcaagcctccatgttaagaaaaaaagagttttaatctctctcgaggaaagaagaatttaaaaagctttaggggccaggcatagtggctcacgccagtaatcccaggtattcaggaagctgagg

SEQ ID NO: 28993 - DNA, 264 bp, Homo sapiens
atggaacagttagccagcccagtcctccctctttttccagtcccagccattttcctagtcctcttgctgcacatgtgtcacatgtggcttctcagcttcatgatcgtgtcatgacagattctctggcctctgctccaacattaccccttgaaatcttggttctactgaccatttttggccttcttctccctcctgtagactgttgagtgcatttggcattttatactctatcctttgtcctctaatcctccacttctatacacc

SEQ ID NO: 28994 - DNA, 780 bp, Homo sapiens
gctcctcacccagcattgtttgggctatgacagtggctgtgacaagaccctaagacgggaagctgcgtgcagggcacttgagggcccgctgaggagaagccgcctgtgagggacaggactgggcagggaaggccaccagccatgcggtcacagcccaggactccgccagtcctgcaggagccctggagccaggcccttgctgtccaggccacttgctgtacctggcccacagctacctcccctgcagccctgagtcctgcttgctgtgcccggctcaggctgagactgcagtgcttgtccattcaccatgaaagaaagaagaacaggaagggaggcaggaggaagtaagttagaggattaatccaaatgttccaactgtctaatgggagttccaacaagaagatatccagggaggaaattcacagtcaaatttccccaaaccaaaggtcatgagttttcaggttgaaagaacacccaaccaagaggagagaaaacagcattctaaatatcggaaggaaacgaaacctcgcctcaggcatgcgggctctgacgggcaggatggcggcacggagggctgctgtatccagtgaagtcagcagttcagatgaaacagataactcccttaaaagacacaaattgccaagactgacgcaaacactgaaacagactgaacagttctgagttaccaatttaaaactgcaaagcaaatagcaggcccaaaaggcttcactgataaattatctcaaacattgaaggcaaaaaataaaaccagacacagca

SEQ ID NO: 28995 - DNA, 419 bp, Homo sapiens
ttggagttccggatatgacatggggccagcgggtcactgctgtggtgaccctccgagaaggacactcactgtcccacagggagctcaaagagtgggccaggttgaaagaacacccaaccaagaggagagaaaacagcattctaaatatcggaaggaaacgaaacctcgcctcaggcatgcgggctctgacgggcaggatggcggcacggagggctgctgtatccagtgaagtcagcagttcagatgaaacagataactcccttaaaagacacaaattgccaagactgacgcaaacactgaaacagactgaacagttctgagttaccaatttaaaactgcaaagcaaatagcaggcccaaaaggcttcactgataaattatctcaaacattgaaggcaaaaaataaaaccagacacagca

SEQ ID NO: 28996 - DNA, 1298 bp, Homo sapiens
gctcctcacccagcattgtttgggctatgacagtggctgtgacaagaccctaagacgggaagctgcgtgcagggcacttgagggcccgctgaggagaagccgcctgtgagggacaggactgggcagggaaggccaccagccatgcggtcacagcccaggactccgccagtcctgcaggagccctggagccaggcccttgctgtccaggccacttgctgtacctggcccacagctacctcccctgcagccctgagtcctgcttgctgtgcccggctcaggctgagactgcagtgcttgtccattcaccatgaaagaaagaagaacaggaagggaggcaggaggaagtaagttagaggattaatccaaatgttccaactgtctaatgggagttccaacaagaagatatccagggaggaaattcacagtcaaatttccccaaaccaaaggtcatgagttttcaggttgaaagaacacccaaccaagaggagagaaaacagcattctaaatatcggaaggaaacgaaacctcgcctcaggcatgcgggctctgacgggcaggatggcggcacggagggctgctgtatccagtgaagtcagcagttcagatgaaacagataactcccttaaaagacacaaattgccaagactgacgcaaacactgaaacagactgaacagttctgagttaccaatttaaaactgcaaagcaaatagcaggcccaaaaggcttcactgataaattatctcaaacattgaaggcaaaaaataaaaccagacacagcaaagtaagtctctgatgaaacagagtggggaggaacacttcctaactccccgtatgggaccagcactaccctgaaatcaaaaccagacaagaaaacgagaggacagtgttcccaatgggcagacacacaaaatcctaaacaaaacgttagcaaattaaatccagttaatgcacaaaaagacaacacgtcatgatcaagcagcatttaacctgggcgacagggcaagcctctgtctcaaaagaaaaaaaaatctacacatccctcaccacactgtacataggacagctgggtgtaaattacatctccatttaaatgcctgtcatagttttatacaactataaaatatatacgtgccaaaataaatttgataggaacattggaaccaggtaaggtgacgcatacctgtagcacttcgggaggatcctttgagcccaggaagtcgaggcttcagtgagccatgactgcaccactgcactctggcccaggcaacagtgagatcctgtcctagaaagaaaagag

SEQ ID NO: 28997 - DNA, 442 bp, Homo sapiens
tattaaaaatacaaaaattagccaggcatggtggtatgcgcctgtagtcccagctagttaggaggctgaggcaggagaatcgcttgaacccgggaggcggaggttgcggcaagccgagactgcaccactgcaatccagcctgggcgacagggcaagcctctgtctcaaaagaaaaaaaaatctacacatccctcaccacactgtacataggacagctgggtgtaaattacatctccatttaaatgcctgtcatagttttatacaactataaaatatatacgtgccaaaataaatttgataggaacattggaaccaggtaaggtgacgcatacctgtagcacttcgggaggatcctttgagcccaggaagtcgaggcttcagtgagccatgactgcaccactgcactctggcccaggcaacagtgagatcctgtcctagaaag

SEQ ID NO: 28998 - DNA, 1181 bp, Homo sapiens
gctcctcacccagcattgtttgggctatgacagtggctgtgacaagaccctaagacgggaagctgcgtgcagggcacttgagggcccgctgaggagaagccgcctgtgagggacaggactgggcagggaaggccaccagccatgcggtcacagcccaggactccgccagtcctgcaggagccctggagccaggcccttgctgtccaggccacttgctgtacctggcccacagctacctcccctgcagccctgagtcctgcttgctgtgcccggctcaggctgagactgcagtgcttgtccattcaccatgaaagaaagaagaacaggaagggaggcaggaggaagttgaaagaacacccaaccaagaggagagaaaacagcattctaaatatcggaaggaaacgaaacctcgcctcaggcatgcgggctctgacgggcaggatggcggcacggagggctgctgtatccagtgaagtcagcagttcagatgaaacagataactcccttaaaagacacaaattgccaagactgacgcaaacactgaaacagactgaacagttctgagttaccaatttaaaactgcaaagcaaatagcaggcccaaaaggcttcactgataaattatctcaaacattgaaggcaaaaaataaaaccagacacagcaaagtaagtctctgatgaaacagagtggggaggaacacttcctaactccccgtatgggaccagcactaccctgaaatcaaaaccagacaagaaaacgagaggacagtgttcccaatgggcagacacacaaaatcctaaacaaaacgttagcaaattaaatccagttaatgcacaaaaagacaacacgtcatgatcaagcagcatttaacctgggcgacagggcaagcctctgtctcaaaagaaaaaaaaatctacacatccctcaccacactgtacataggacagctgggtgtaaattacatctccatttaaatgcctgtcatagttttatacaactataaaatatatacgtgccaaaataaatttgataggaacattggaaccaggtaaggtgacgcatacctgtagcacttcgggaggatcctttgagcccaggaagtcgaggcttcagtgagccatgactgcaccactgcactctggcccaggcaacagtgagatcctgtcctagaaagaaaagag

SEQ ID NO: 28999 - DNA, 266 bp, Homo sapiens
caccacaaagaatacttgagtttgttgagttactgagttgaattaatttattaatgtgccatagccaagctttgaaagcccctgtcaggttagggctggggaaggctcactaaagatgggctgagagttggggcttcagaaagaacccaagagagaaggtaaagtttactggtttaaagtacgactctgtagccagcttcttggatcaactcttgggtccactacttcacattgtgtgaccttgaataagagactttaactcttta

SEQ ID NO: 29000 - DNA, 384 bp, Homo sapiens
atccgcccaccttggcctcctaagatgcccaagttgctgctatgccaacagcctgttctgccttctctaagctccaaagaccaacttttgtccttctgctaaaacaggcagcagaactgcctctgttagagttgtggatgtcctttggtttactggagaagccagagtgcctggatgcaggtcccagcctcgccctgcctggccacaccccagggcaagcaacctgcattctgcatcccagttttgatatatagaaagtgggaatggccgggtgcggtggttcacgcctgtaatcccagcactttgggaggccgaacctggtggatcacgaggtcaggagatcaagaccaccctggctaacatggtgaaaccctgtctctacta

SEQ ID NO: 29001 - DNA, 428 bp, Homo sapiens
agtagataaggaagccagccaacacccctgtaggagttagagtcactggccatggagggcataggtttaggttcaaaccaacctggatttgaatccagctgtgctactttctagctgtgtgatcttgggtaaaggtttacacctcagtagggcacagtggctcacacctgtaatcccagcactttcggatgccgaggagggtggatcacgaggtcaggaatttgaaaccagcctgaccagcatggtgaaatccctgtctctactaaatatgcaacaaattagccaggcatggtggtgggcacctgtaatcccagctactcgggaggctgaggcaggagtatcacttgaacccaggaggcggaggttatagtgagccgagattgtggcactgcactccagcctgggccagacagagcaagactccatca

SEQ ID NO: 29002 - DNA, 398 bp, Homo sapiens
tatttcctcttctgtcgttccccaactgttagatgtttcttagttgaggcgtccgttttgtgaatatgagaataaagcacgcatttgttgctgaataagttgatctttgctttctaaagactccagcaaacattctaagttagtggttttcctgttgagaatctctatgtgtaatgagagatttgctgttgagattgtgttatacatgtgtaaagtatgaatgcagacaaaaggttgaagattactagtgtaggaatgaagacctgctccatctgtaatcttgttttgcttgctcttccttgcccttctctaccacggttggtcattctcactgccaaggaacctgacaatgttactcttgcttggcgttttaagccttggtgtgtaagcattacagg

SEQ ID NO: 29003 - DNA, 402 bp, Homo sapiens
ctcccaccaggccccacctccaacatttggaatcacatttcaacatgagatttggggggggacagacatccaaaccatatcacataggaggaaaaacacacaggaagagcacacaggtgcacttcccttagtgccttctgaaggacgcaactcaggtttttatgatatactgattaacgggttattgttatgggctttgtcttggattttaacctgatactttctcagtgttggttttgctagatgttcattacttcattaaacagaggtgccgggtgcggtggctcacgcctgtaatcccagcactttgggaggccgaggcgggcggatcacgaggtcaggagatcgagaccatcctggctaatacggcgaaaccccatctctactaaaaatacaaaaaat

SEQ ID NO: 29004 - DNA, 451 bp, Homo sapiens
gttaagtccctagttgtgaaagcttttggtagggccagtttttttttcttcttcgttttaatttccctcatttgagaatgttgtagtcatcattgggtgtcatcattcaccagtttgtgaagggagttaaaggaaagtgcattcctctcccatcttttctttctttggggtttaataaattgtgggaaactaagactgtgttctagactgtacaccatgcagtttatattatgatcttctgtcatctttgcagcctcagattccatttttagctaagactggggttttaaataacttgtttaaggttcctacaactaattgtcacaattggaattcaaacaattctaggtatttttgactacaaagatctaagatctttgcagagcaagcctatctgatgcttaaaaaaatatatattttttaaatttttgagactccatctcactccgtt

SEQ ID NO: 29005 - DNA, 271 bp, Homo sapiens
ggcatagaactttaattcacattattgtggcttgtgaaaacattttattacctttgttttagtttgtatttcattcaacaaataaaaagtttggaaagagttaggcacatgataaaattggtaacttagtttatagaatagagttcagcttcagccagtttcctgtgaaaccaaatgctatttcatagaattagtgtcatgttgggagggccatgagctacagactttcactgttactagggatatttttagatttgtcccattttgtcca

SEQ ID NO: 29006 - DNA, 1079 bp, Homo sapiens
ttttaatatggctgggaatgcagaaattttaaaaatggatacatttgagtgtgttaaaagtaaaaacttctcttggacaaaacataaactgctaaccgcaacgggggagaagatatttgccgcacatgtaaataacagagactgttctacagcaccaggaggaattctgactgccaatgggtgaagacgaggcacccagggaaataaaggggcagggatggggcagccctccacgcagaggagacgcctgagaatgcgcacattcactggttgtctatctctagacaacagcagatgcctcttcacaccaatcgatggcacccagaaaggcctaggatgtgccctgttcaaactctccctgcggtgcagcttaaatttctatagagaaattcgggagacatttggccgcatctgaaagcgcagaaggtgcgtgctccctggcacccagcacacaggtgttggggaagcggggacgaggcagccctggagcatggtttgcaggagtgcaagactgcaagcctcctccacggccaccactccaggcctggataaagaattcgtggcatatttcagggaacagaatgtcccctggggcgaaaggggatgaagtcattctacttgtaccaacttgagtgcctcctaaaagtgtaaccttgggggcggggatacagaaggatgatgctgacaatggaatttaaaaacaaacagcaacattttgtggtgtctacaggcgtgggggtggaggagctgcagcgtcaccatgggaacaaaagtctcccacgcatctcaggcccgaggaatctttaaagagggagagtgggcatgggaggaggacttaagctattagtcatattttatttcgaaaactagatcttaagtaactgtagcaaaatgttaacaattcttaccttggaataccggttacatgggattatgttactctattttttcatcatgtgaaatattttatattttgacaattaaaactaaatagtagctttttataaaagtggcatatgcactgaagtataatgtgctaatttgggattcgtttaaataaaacagctttcttagaatat

SEQ ID NO: 29007 - DNA, 828 bp, Homo sapiens
caccaccatgcctggataattttttcttatttttagtagagacaggatttcatcatgttggccacgctggtttcgaactcctgaccacatgtggtccacccaccttggcctcaattatgtgcattttggtatatttacttgtatttcaacatcttgtgagtttgaaaaacctgaaaggccagaatgcttccttttatttctcaccatttgggcagcacctaagtggttttgtaaaatgcagcatctggtgctgtgggtctctctcaggccttgagggacacttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagaccgaatctttagggtgaagagctccccaaagccatctggtgaggtcattgtggggaccagggactgattatttgtcacctggatcacaaagatgggactgtctgctcaggctggtggtgacaggatcctgacccgtggtcctctcccgttccctctgcttccaccaggacacatgtataggacactgtgctgtgtgcagtggagaaatctccctgggccaggggaaagttcagacagtgcctctagattgtgttttggctcctccaatgtagagttgacatctggaccccagagcccagcagggctttctgtcagacatgctagggtggtagaaatgggccctccaggtccccctgcagtgca

SEQ ID NO: 29008 - DNA, 269 bp, Homo sapiens
gaaaacagtctgtacagcaaatgctgtgtgagatcttaggcttttcactttttttgttttgttttgtttttgaaagaaagaaaaaaatacaattaacaagcctcttttgtaaatgggtttcctttctatgtataaaatcgtggtggtcccttgtttttacatgttcatgctgtgtaattttgagatgttactgagatatgttctgaacataatgtgcatttttttctgtacagatgaaatgggagaatttaataaagagtttgcaggtt

SEQ ID NO: 29009 - DNA, 657 bp, Homo sapiens
catgagaatttaatctcaaaacagaaatcagaaaaatatgaagtccagggcataaaacctaaaactattgctcatatttattctttctaaatagagcaaagtgtacaatcttctccataagacatacattgtggttataaaaaggcaaaagtcttagtgagaatcattggtattccatagaagagtgaattaaacacagccaagggaagacccacgtctcatacttctcttgtatattccaaagttccagggaaattccaggtgatagaggttatttcccatactgttaaagcaaggtttcagacacttctgaattttggtcccagtactctagaagggcacacctctgtcctggaaaataatacaggaatgaatactcttcccgtgacccattctggtcattcttccagcatcacaaaaaccaaaaaatggaaatatggccaaatacgtgattagctgtccctcatcttcaggtttcttatctgttacttatagataatagcattaccttaaggattatgatgaagatacaatgtccaaatataaacacagttttgagcaaaatgccttgtacgaattggtcaatgaataattactaaatatgtgaatatttactggattgtatggatcctatgaataattactgaataattattg

SEQ ID NO: 29010 - DNA, 401 bp, Homo sapiens
ccagcagactgcatccccaagaaccatgcctgaaggatgggaaggcacttttccccactaaaaccactgagagccccctggccaaggtgaacagggatcagtgctttacctccgaagtggtttctaaggccctgaaacaagaggtggccaaccctgtcaagattacctataggtgttcatatggggggctggacatgatgcaggcgccgggaccctctaaggaagaaattatctataagatcatgcggcttctctgggccacttcctactgtgggccgcaaccctgtggctgattgagacctcatgtgaagcctccctgccccagcacccttcccattgcccttcagaggagcagttcttggatgacccagatttgaatcattaaagtagactctcatgca

SEQ ID NO: 29011 - DNA, 903 bp, Homo sapiens
caatgtttctaacaattacattgccttgctgattatacacagtgatgacatttagatcataaacatgtctaagaattttcttatgtttagcattcaaacaagggccgtcctaaacagctaaataagcctcatcctcacagaagcgaaagcttctagatgggcttggtgttgttcatcaacgaggttttatcaggatagtggcaattctggtgaatgacggactgagcccctcttgagaactggatgtgtctgcttgggctgcatgccatttcccacccagtgcttaccatgctgctagcagcaattagggtcgactcaccttagcagttgcatggagcagctgtttcttccaaagcaagttgggactggaatttggccatataatcacacagttaaggacagctctggcatttatatatgaatctcagaattttaggtacaccatttcttttccgtaaataaaatttctttctgcttttaagtgtcttttcctgattctacatagaaaatttgatgaatatttacagccataaaaaagaatgaaatcatgtcctttgcagtaacatggatgcacctggagaccattattttaagcgaactaatacaggaacagaaaaccaaaaagcacacgttctcacttatacgtggtagctaaacattgactacataaagatgggaacgatagacagtggggaatgcttgagagagagggtgggggaggcatggattggaagactaactgttgggtactgtgcttactaccttggtgatgggatccttcgtacaccaagcctcagcaacacacaacctacccgtgtaacaaacctgcacatatatctcctgaacctaagataaaagtagaaaagaagaaaaatgtaaaaaacatttgcttaagtaagaaca

SEQ ID NO: 29012 - DNA, 945 bp, Homo sapiens
tcctgagttcaaatgattctcctgcctcagcctccctagatgctgggattacaggcgcccaccaccatgcccagctaattttttttgtatttttagtagagacgggtttcaccatgttggccaggctggtcttgaactcctgaccttgtgatccacccgccttggcctcccaaagtgctgggtttacaggcgtgagccaccgcgcccagccttataattttttataaagtagataaaatgttttgaaatagttaaaatgtatttgcatgaatatccatataagttaaatatgtataactagggaattctttcttaagaggtgattaatatagataacagaaatctcatgatttcttcccgcttgagatactgttcacaggtattttcacctttaagaagccttattagagttgcttataggacccttcttggtgcatttaaatgcttatatacagattacattaattgcagtactatcatatcagttattgagtggccagcattaatacatttgtcctatttttctttctctgtctttttaaaaaaagacctttattgaagtgtagttgacatacagtaaactgcacatattaaaggtatacatgcgccatctcagttcactcactgcaacctccgcctcccgggttcaagtgattctcctgccttggcctcccgagtagctggaactacaagtacaagacggggtttcgccatgttggccaggctggtctagaactcctgacctcaaatgatctgcccacctcagccacccaaagtgctgggattacaggcatgagccaccaccgtgcccgctgtgccatttcttttctttttttttttttgagacaggctcttgctctgtcacccaggctggagtgcagtggcgcgatctcggctcactttaacctctgcctcccagattcaagcgattcttacacaacagcc

SEQ ID NO: 29013 - DNA, 407 bp, Homo sapiens
ttttttgagacagagtcttgctgtgttgcccagggtggagtgtagtggcgtgatcttggctcactgcaacctccgcctcccgggttcaagcaatcctcccgtctcagcctcccaagtacctgggattataggcacatgctatcacacctggcaaatttttgtatttttagtagagacagggtttcaccatgttgaccaggctggtctcaaactcctgaggctcaagtcatccgcctgcctctgcctcccaaaatgctgggattacaggactgagccactgtgcccagatgttttctacagtcttaggatcacaacttctgagtcagctaaatataaacagaaaaccccagagaaactctgacatattaacggggagaaataaagaatagaaccataggcctctgctg

SEQ ID NO: 29014 - DNA, 163 bp, Homo sapiens
aacacatatcaaataccaccaggtccttttaaagccttctcacttcttgagatagaagggaagtacttcgggctgggcacggtggcttgtgcctgtaatcccagcacttttggagatggaggcaggaggatcacctgaggtcaggagttcgagaccagcctgg

SEQ ID NO: 29015 - DNA, 423 bp, Homo sapiens
gtcagggctaggtctgctgtgggcgtatgacaggagacattttcctgcacgtctcagggctttgccacagcccgtgaagttagggaagaaaaggaagaaaaacaaagcaggctacaaaacagccaggtctgtactgctgaatccctagcccttaagcacagtctctggcacagaataaatacgaaatgaatgagtgaatgaatggatggatgggtgaagagaaaaggcaatgcacaagatttacctatcaaaatccaccaatggtccttaaaaatggttttgtcagtagagatgctgaatatattcatataatacatttatttcaatactattaagaattctagtgtttttttttctctttgggtatgtatacttaatgaatactggtagcacagggtcccaaattcaatgaagttttctttg

SEQ ID NO: 29016 - DNA, 477 bp, Homo sapiens
cagcttcctaagtcaaacaatacccaactgcagtataaacaaagtcacggacaactggcttgtttaaaacttatggcgcttgagcaggagttttctttttaaccttttctgctaagagactttttttttcctacacatcaactgtacttattcatgccctctctgaaacccacatctccagtaattacaatgagtttagaaacaagtgtggaagaaattggaccatacgataccttcccctaggcatctaactagatgtcactttggaaattaagatgagcttcctaattctagaaagaagccaccagaccacagatgcctgtaaatcagctgtgaagacatcagatagaatcatttgggcataaataggaaattaggggggcatttgtcatttaaatatgtatttgaaagctttttttttttttcttacaaaaaaccattttgctttgttttataacagtattgactggcggggca

SEQ ID NO: 29017 - DNA, 680 bp, Homo sapiens
gcggcgttggtccggtgcgtcctgttctacagctatggccgggccagctgcagctttccgccgcttgggcgccttgtccggagctgcggccttaggcttcgcttcctacggggcgcacggcgcccaattcccagatgcctacgggaaggagctgtttgacaaggccaacaaacaccacttcttacacagcctggccctgttaggggtgccccattgcagaaagccactctgggctgggttattgctagcttccggaacgaccttattctgcaccagcttttactaccaggctctgagtggagaccccagcatccagactttggcccctgcgggagggaccctgctactcttgggctggcttgccttggctctttgagctcccttttgcttaattactgggttttctgggcagttttttttttaaagagttggagtaagaagaggattaaaaaggaaaggcaaataaaaaaaaaaacaaaaaaaaaaaaactctcggagggcttctatttgcggggtgggggaaaaaacggtgtcttgagatttgggccttgggtcatacgtggttctcctggacccggtttttttgttacaatgtgggaaatctgcgagggtcccccctattaggggggtcggtattaatttcggataacgccgggttaacctggttttgttctctcaga

SEQ ID NO: 29018 - DNA, 567 bp, Homo sapiens
gcggcgttggtccggtgcgtcctgttctacagctatggccgggccagctgcagctttccgccgcttgggcgccttgtccggagctgcggccttaggcttcgcttcctacggggcgcacggcgcccaattcccagatgcctacgggaaggagctgtttgacaaggccaacaaacaccacttcttacacagcctggccctgttaggggtgccccattgcagaaagccactctgggctgggttattgctagcttccggaacgaccttattctgcaccagcttttactaccaggctctgagtggagaccccagcatccagactttggccctggaatacagtggcgcgacctcggctcactgcaacctctgcctcccaggttcaagcgattctcctgcctcggcctcctgaatagctgggattacaggcgcctgccaccatgcccaactaattttttgtatttttagtagacacggggttgtgccatgttggcaagctggtctcaaattcctgggctcaagtgatcctcccaccttgcccttatcgggtaccgagactcgagtcgtatcatg

SEQ ID NO: 29019 - DNA, 361 bp, Homo sapiens
  misc_feature (60)..(60): n is a, c, g, or t
  misc_feature (66)..(66): n is a, c, g, or t
  misc_feature (287)..(288): n is a, c, g, or t
  misc_feature (291)..(296): n is a, c, g, or t
  misc_feature (300)..(303): n is a, c, g, or t
  misc_feature (305)..(305): n is a, c, g, or t
  misc_feature (312)..(312): n is a, c, g, or t
ctaattggtgctggtttctccgcccgccagacgtcttcgccactctgcagcggttttacnaaaggncgggtgaagagcgcaatgctgaaatgaacacggcccggattgggcgcctgtgaaccttatttgcatgggcggtcgggattggctggcctcttgggtggcctgggcggcgttggtccggtgcgtcctgttctacagctatggccgggccagctgcagctttccgccgcttgggcgccttgtccggagctgcggccttaggcttcgcttcctacggggcggcnnacnnnnnnggtnnnncnagggggnctggggacgaagatgggactgtgcttggggcgtcctctggggtctgctg

SEQ ID NO: 29020 - DNA, 468 bp, Homo sapiens
gcggcgttggtccggtgcgtcctgttctacagctatggccgggccagctgcagctttccgccgcttgggcgccttgtccggagctgcggccttaggcttcgcttcctacggggcgcacggcgcccaattcccagatgcctacgggaaggagctgtttgacaaggccaacaaacaccacttcttacacagcctggccctgttaggggtgccccattgcagaaagccactctgggctgggttattgctagcttccggaacgaccttattctgcaccagcttttactaccaggctctgagtggagaccccagcatccagactttggcccctgcgggagggaccctgctactcttgggctggcttgccttggctctttgagctcccttttgcttaattactgggttttctgggcagttttttttttaaagagttggagtaagaagaggattaaaaaggaaaggcaaataaaa

SEQ ID NO: 29021 - DNA, 409 bp, Homo sapiens
  misc_feature (56)..(56): n is a, c, g, or t
gtgggggaaggaactttggtcccttgtgtcatcaggggatctcagtacctgtattngcctacgacatcccttcgtttctgtttttcttacagctgtttgacaaggccaacaaacaccacttcttacacagcctggccctgttaggggtgccccattgcagaaagccactctgggctgggttattgctagcttccggaacgaccttattctgcaccagcttttactaccaggctctgagtggagaccccagcatccagactttggcccctgcgggagggaccctgctactcttgggctggcttgccttggctctttgagctcccttttgcttaattactgggttttctgggcagttttttttttaaagagttggagtaagaagaggattaaaaaggaaaggcaaataaaa

SEQ ID NO: 29022 - DNA, 4497 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29023 - DNA, 3999 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29024 - DNA, 4927 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgagtgctcctcgcggccttttgctcggagggagttgtcaaccgcgccagatccccttgatggctgtggcttcggaacctcgcggccagcactgccttttcgcctttttaaaatatgggaacaccctgatttaagcagcggttgtcttccagaaggtcctttgattttagggggaaatgcattagccaggtcaaacagccgatttgaaacacagaaggctaagttgacattttacgttattttctaaagtttaggccacttggttcttggttctaagcagagatccttggaacacacctaccaccaccatcagaaccatcactacccatgcatggggacccattcttgtgacaagtttgagcggctttagatcttatgaagcccactgtctcccttgggcagtgtgagcatgggaggagccagacacaggtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29025 - DNA, 4204 bp, Homo sapiens
gcactcgcggcggaggcaagcggcggcgcgcggacggttggtccagttctccggcctggcggcaggtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29026 - DNA, 4177 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29027 - DNA, 4258 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29028 - DNA, 4054 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgccaacaggtcaccttcaagccagtgtcctgacccagtgccttaaggttttggtgaaattagccgaaaacacttcctgtgatttcttgcccagagccgcaagattggggagaactgtgaacacaaccagcccaccccctcatccagtaatccagtctccctcagcactctaccaaagggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29029 - DNA, 5224 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggtattaagctgcataggagtcatgattctttgtgggtctcacctgacctcttaaggtctaacccatggcacttgtactttgctcacatcttgacttatctacactagttagttctaaggcttggttcagggagttctgaagtgatgggaagtggggccaaatgggagaaccaaggaagtggtttatttgatttaattctgcctctgaacaacaggtaagcaaaaggcacacatgattaaaggaggctgctaacctctgtggaggagggccctgccccaggacaagggttaagacaaggggcctctgaacctgagatgtgggtaaggtgaagaccacacatcacaagcacgttgaagtttagtggtttccctaaggaagcagaggatgtggagagggtctgcagcccacgggctgaccttgctgggagtctctgcctgtcattgtgcccatctttagcatgcatctggggtggcctgttcttcttaaggtttgtgggtagtatattatagtgaacctagcgaatgaacactgtgatcataaattcctcccttgggattccagagccgcaagattggggagaactgtgaacacaaccagcccaccccctcatccagtaatccagtctccctcagcactctaccaaagggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29030 - DNA, 3755 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacagcgagagccgcgggagagtgtgcagccgagtcactactgcctgcctgcctgcctgctacgcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29031 - DNA, 4029 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacgatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29032 - DNA, 3739 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacgtggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29033 - DNA, 3046 bp, Homo sapiens
ctgcatccctgtttgggagcatgtggaagccaggcatcccagatccaggaggtcatcccacttcctgggcgatgctacaccagataagggcctgtcctctcagctgcagcagtcttgcagtggaagtgcccacttgttcacatgaaacaagtttcatagcaagtaagtaggggtcaggccagcactgaaacccaagtctggctgaaccaactcacctgttcatactgacttgctcaattttctgttacctctagtggagtgtgaaggtaggttatggagctggggttggggagtgtcacgtctctctgggtccctgtcttttaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29034 - DNA, 2877 bp, Homo sapiens
tttctttccgctgaggagaaacggagctttaattcattttagtaacaagagttgataaagcaactaaagaggtaaactcagtttgggggctgtgcaccacacagatgcaatgcagacaggacttggcagagttgcctgatgactgatcctgtcttggctttgggacgtgggggcagaatagggggctggaggcaggtgggttgctggtgacacatgagtgcttgtcctgggtcttccctgggaaggtcccacaccacttcttggaccccatttgtgcagacaaacagttgctgaagcaagtgaactcttatagaagcttaagaaaaccctcgcagggactggtctccttctgcccaggatggaaccactctgttcttgttctaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29035 - DNA, 3045 bp, Homo sapiens
tttctttccgctgaggagaaacggagctttaattcattttagtaacaagagttgataaagcaactaaagaggtaaactcagtttgggggctgtgcaccacacagatgcaatgcagacaggacttggcagagttgcctgatgactgatcctgtcttggctttgggacgtgggggcagaatagggggctggaggcaggtgggttgctggtgacacatgagtgcttgtcctgggtcttccctgggaaggtcccacaccacttcttggaccccatttgtgcagacaaacagttgctgaagcaagtgaactcttatagaagcttaagaaaaccctcgcagggactggtctccttctgcccaggatggaaccactctgttcttgttctaggtggtgtggctcctggctaagcttggtgtgcagagccccttgcccccagtcactggctccaactgccagtgtaatgtggaggtgagtgggtaggggccaacagctggcagctctggtggtaagggggccccgtgcaaggactgtaggccccactgcaaaccccctcacgtgaggtggctaggctgagcggattgttagggtgcaggccatggtggcaccaggcctcagtctgcaccccccctctctcaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29036 - DNA, 4281 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccatagcactgagtggtcaattggctcctacccttcttggcagcacagacctctgcccacacccagggacctggggaggagggcacagtgtttgtccctcactttccct

SEQ ID NO: 29037 - DNA, 4981 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaaggtaagcctgccagaggccatcctgcccagcccccatggcttcttccagaggttccccaacaagtcagattcctgggtgtcccctcagcaggcccccgcccactgcagcctgttccagcactggggccattttcttttatcttcctgcctcagttcttctccaagcatattgggatgccttttgcatctatctgttgagtgtgcctggcagagccacggtttttccagaaatagccgtgtctgaattgcctttgtatcactttgtttgcagtagctgagggagcagggcctgggtgtggaagggactggttagttcctgcggacgttgggggaggagaggtgggacctgccctaggccctggcacctttgggccctcaccaggaacctctcctttttgtctcagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29038 - DNA, 3448 bp, Homo sapiens
tttctttccgctgaggagaaacggagctttaattcattttagtaacaagagttgataaagcaactaaagaggtaaactcagtttgggggctgtgcaccacacagatgcaatgcagacaggacttggcagagttgcctgatgactgatcctgtcttggctttgggacgtgggggcagaatagggggctggaggcaggtgggttgctggtgacacatgagtgcttgtcctgggtcttccctgggaaggtcccacaccacttcttggaccccatttgtgcagacaaacagttgctgaagcaagtgaactcttatagaagcttaagaaaaccctcgcagggactggtctccttctgcccaggatggaaccactctgttcttgttctaggtggtgtggctcctggctaagcttggtgtgcagagccccttgcccccagtcactggctccaactgccagtgtaatgtggaggtgagtgggtaggggccaacagctggcagctctggtggtaagggggccccgtgcaaggactgtaggccccactgcaaaccccctcacgtgaggtggctaggctgagcggattgttagggtgcaggccatggtggcaccaggcctcagtctgcaccccccctctctcaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaaggtaagcctgccagaggccatcctgcccagcccccatggcttcttccagaggttccccaacaagtcagattcctgggtgtcccctcagcaggcccccgcccactgcagcctgttccagcactggggccattttcttttatcttcctgcctcagttcttctccaagcatattgggatgccttttgcatctatctgttgagtgtgcctggcagagccacggtttttccagaaatagccgtgtctgaattgcctttgtatcactttgtttgcagtagctgagggagcagggcctgggtgtggaagggactggttagttcctgcggacgttgggggaggagaggtgggacctgccctaggccctggcacctttgggccctcaccaggaacctctcctttttgtctcagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29039 - DNA, 4002 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29040 - DNA, 3855 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcatccacccaccggagcagggcctgtggtctccactgacagatgctgagcagggccaggacatcaccctcagccgtgtgcgagtctggaggggactgcccatacaggcgagttgtggatgctgcctaggctatagctcttccttgggccgtgttctgaggggctgcttgctcgct

SEQ ID NO: 29041 - DNA, 4051 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagcctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccatagcactgagtggtcaattggctcctacccttcttggcagcacagacctctgcccacacccagggacctggggaggagggcacagtgtttgtccctcactttccct

SEQ ID NO: 29042 - DNA, 3534 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggtcatccataaactaggggtgccgagctcgaaagg

SEQ ID NO: 29043 - DNA, 2212 bp, Homo sapiens
ctcggtccattatgaacaaagattcaatatcccaccgcccacccactacttcaaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 29044 - DNA, 2545 bp, Homo sapiens
  misc_feature (2533)..(2533): n is a, c, g, or t
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacattgtttaaacgcagcccaggcgggnccaagcttcctt

SEQ ID NO: 29045 - DNA, 2557 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggtattaagctgcataggagtcatgattctttgtgggtctcacctgacctcttaaggtctaacccatggcacttgtactttgctcacatcttgacttatctacactagttagttctaaggcttggttcagggagttctgaagtgatgggaagtggggccaaatgggagaaccaaggaagtggtttatttgatttaattctgcctctgaacaacaggtaagcaaaaggcacacatgattaaaggaggctgctaacctctgtggaggagggccctgccccaggacaagggttaagacaaggggcctctgaacctgagatgtgggtaaggtgaagaccacacatcacaagcacgttgaagtttagtggtttccctaaggaagcagaggatgtggagagggtctgcagcccacgggctgaccttgctgggagtctctgcctgtcattgtgcccatctttagcatgcatctggggtggcctgttcttcttaaggtttgtgggtagtatattatagtgaacctagcgaatgaacactgtgatcataaattcctcccttgggattccagagccgcaagattggggagaactgtgaacacaaccagcccaccccctcatccagtaatccagtctccctcagcactctaccaaagggtcagtttctatgttggaatgattccactggctgaatatatcttaaatcatctca

SEQ ID NO: 29046 - DNA, 1994 bp, Homo sapiens
gcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggtattaagctgcataggagtcatgattctttgtgggtctcacctgacctcttaaggtctaacccatggcactgtttggactctgggcactgtttggactctgggcactgtttggacactgggcactgtttggacacta

SEQ ID NO: 29047 - DNA, 353 bp, Homo sapiens
acccaggacaactagaaaggtcagggtagaacccagagtcagtaagagtggtagtaacagtatgcaggatttaggtttggctccagagacctggacttcacacatcaactgtcatcacattacgctgggtctataaaactcaatatctaaatcaatctgcgtgtgtgtttgtgtgtgtgcacatgtgcatacatgcatgcttgcccatgattatggcgtgaagtaagttcaggttttgttgttgttgttgtcgtcgtcgtcgttgttgctgttgttgttgttgttgttgttgttttgaaatggagttttgctcttgttgcccagctggagtgcaatggtgcgatctcagctca

SEQ ID NO: 29048 - DNA, 331 bp, Homo sapiens
ctacttatttctcccccagatattttctatgtaaagattagctgttgaagctattacattctgggtggtgctagaaatcattacttaaggaatagaaattagaatgttgttatacatttaccaaagcaaaagagcaataatccaaattttaatcagatcttagaggaaacatttttatagctgtttattacaagacctcagagttttcttactgtgagcactctcaaaattatctaaagtatttttttaattgaactattggtcatagttattaatgttattaatatattactataaaaaggcatagaaaaatcataataagaaacagata

SEQ ID NO: 29049 - DNA, 262 bp, Homo sapiens
tggctgtaggatacttattcttgcttccaatagaagccatagtgatgactttagtgatggatgcctcagctccatcctgttgttcctcagcttctggaactcaggagaagagactagggaggatacgcctgcttgtctttctgagtaattggtatgattcttggagcagcattgtcttttgtacagcaccatctctgtatattcagaacttaggaaaaggataggcacatcataggaattagtaacagttttcccagtgtgt

SEQ ID NO: 29050 - DNA, 333 bp, Homo sapiens
aatctttgagatatatgaagtcatccctgaatactgtttaatgctctggttaaactccatttcactctgaccaatcagagtatgtgagctgatcataaggagctattatcaagagacttgtcagaggattcactgcccaatatgtttttatgaccctttttatctgtaagagttgctggtattgctttttagaatgaaatagactaattttgtccattacagtgttgatagtttgataactcactgtgggaatcaattgatcttatcagaataatataaccagtagaggaaatgtaactgaagcatatacagttttatttaatatattgttta

SEQ ID NO: 29051 - DNA, 413 bp, Homo sapiens
acaaatgagtgaaactaaaattcaaaaattggggacttgtatgctatttgatcatggtcaagatgacaagaatatatcatttaaaatattatataatttaaaagtagttgtgcattgaaaatgcgtgacaggctgggtacaggggctcatgcttgtaatcccagcactttgggaggccgaggcgggcagatcacttgagatcaggagtttgagaccagcctggccaacatgttgaaaccctgtgtctactaaaaatacaaaaattagccaggtgtggtggcaggtgcctgtaatcccagctactcgggaggctgaggcaggagaatcgcttgaacccgggaggtaaaggttgcagtgagccaagatcgcaccactgcactccagcctgggtgatagagtaagactcagtctca

SEQ ID NO: 29052 - DNA, 675 bp, Homo sapiens
atggcattttatcccttgcaaattgctgggctggttcttgggttccttggcatggtggggactcttgccacaacccttctgcctcagtggagagtatcagcttttgttggcagcaacattattgtctttgagaggctctgggaagggctctggatgaattgcatccgacaagccagggtccggttgcaatgcaagttctatagctccttgttggctctcccgcctgccctggaaacagcccgggccctcatgtgtgtggctgttgctctctccttgatcgccctgcttattggcatctgtggcatgaagcaggtccagtgcacaggctctaacgagagggccaaagcataccttctgggaacttcaggagtcctcttcatcctgacgggcatcttcgttctgattccggtgagctggacagccaatataatcatcagagatttctacaacccagccatccacataggtcagaaacgagagctgggagcagcacttttccttggctgggcaagcgctgctgtcctcttcattggagggggtctgctttgtggattttgctgctgcaacagaaagaagcaagggtacagatatccagtgcctggctaccgtgtgccacacacagataagcgaagaaatacgacaatgcttagtaagacctccaccagttatgtctaa

SEQ ID NO: 29053 - DNA, 760 bp, Homo sapiens
gttcttcttacatcaagctttccccttgttgcctcatactgactgacttctcccaccccaggcaggagaccccaacagggagatacccctctctactcttcaggaatatttggggttggtgacagtgcccctttccaattctgaaatgggtgaaaaccctgctggcatgtggcaccttatattagcaataagggcctaacagaatgacctgtcttcttctgtacttccagatgcagaagtggccctgaatcttggcttcttatgtaatttcatgagcaatttgttaacttctggaagagccaccgttagacctgtgctaccctcctcccatagtcacggtagtgagttttgagggcagaaatggtggtagtagtatttcttcttgagagatggtggttggatctaagagtcacatattcagaatttcctttagctgcccctaaagagattaagaaagtactggccagccgtggtggctcatgcttgtaatcccaatactttgggaggccaaggcgaaggattgcttgagtccaggagtttgagatcagcctgggcaacatagtgagacctttgtctctacaaaaaaaataaataaataaacattagctgggcctggtggcacttgcctataatcccagctactcaggagactgaggtgggagaactgcttgaacccgggaggttgaggctgcagtgagccatgattgcgccactgcactccagtctgggcaacagagagagaccctgactcaaaaaaaaa

SEQ ID NO: 29054 - DNA, 395 bp, Homo sapiens
ttttttttttgagacagggtctcactccggtcacccaacctcaattgcagtggcatgatcacggctcactacagcctccacttcccgggctcaggtgattctctcacctcagtctctcgagtagctgggaccataggcgtgcaccaccaccaccagctaactttttgtagagacaaagcttgtccatgttgcccaggctggtctggaactcctggactcaaacaagcaatctacccactttggactcccaaagtgctaggattacaggtgtgagccaccacacctggcctccactgtctttaaataatgaggttttaatttttgctcgtgtgaattatcaagattttttgttttatagtttgtgcttttggtgtcctaagaaatcttcaccaacc

SEQ ID NO: 29055 - DNA, 431 bp, Homo sapiens
ccgagatcgtaccattgcactccagcctgggtgacagaatggaatgagactctgtctcaaaaaaaaaaaaaaaaaaaaaagaagccctagatttcggttgtgttggttgtaaaaggagagacccagtaagtgggggttgtgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccacgtggtgtgaccacatggagccacagacacccagcaaggacacgcagcccgcacacccccggtactccagacacagtgacctgcaccagggctcgag

SEQ ID NO: 29056 - DNA, 373 bp, Homo sapiens
gaacacagcaacctggcactgtgttattgcccttagaatggaatgaatatatgtttagcacaaggtaggaagtgatgcgttaagttggaaggctttgccgatcatggtgtgtatgttgactaacctttattgtgcctttaaaaaatatactcaagaactaccttaaccaagtaattaaagtcaagattaccagttgtgggacaaatgacatgtacttcctggtgtgatatagaaggaaggacacagtatcacctatatagtattcttgaccagaatatttaacctgattttaaacaagaagtaaaaattcaaataaatttagattgtggtgcattcaaggcctgaactttaataaatgtccatgtcacggcag

SEQ ID NO: 29057 - DNA, 364 bp, Homo sapiens
caaaggccacaaactcaaatgactatagagtacatacaggtaatgtaagtgaatggcagtcaagactggggtatagtgaagaatatatgcatcatgtaagaagaacggctgattgttttcatgtgagaatgcaggcctaagattgctagatctgagtcttcaggaaaagccaaaagttcagaggtttatatgatgtctcatattgggaactaattccacttaagggaaaaaaaaaaccctactactgggggaacttaataaaacatagcaaattaattgcatttggccaatgagcttccaattttcatctgctctatacgattaatgtagaaacacaatttctcccttctttttattgtgctta

SEQ ID NO: 29058 - DNA, 103 bp, Homo sapiens
cctccgtagtcatatccttaccctgatgtattgctgtgtttcatcctcactccaaaatgcattttatatgttgtaaatatttttctacctttgtgttgattta

SEQ ID NO: 29059 - DNA, 410 bp, Homo sapiens
agtcatttggatcaactcctctcagtaaacaaatgaagaaacttaggtccagacacttgttaaagcccagtaagctatcgtacggcagagctgaaactaagattatgcttgctttatcatactgttaagtggaaattgaggccatgaaaaaggaaaacgtttgcatattaaatttgagaaaacaaactcagcagaaagaccacaaatatatgtgcaaaataaaattatcagaatacattaagatatgtcactattggccaggtgtggtggctcacacctgtaatcccagcactttgggaggccgagatgggctgatcacctgaggtcaggagttcgagaccagcctgaccaacatggagaaacctagtctctactaaaaataaagaattagccgggcgtggtggcgcatg

SEQ ID NO: 29060 - DNA, 381 bp, Homo sapiens
atgcctgaaccagtcaaatctgctccagtccctaaaaaaggctccaagaaggccattaacaaggctcagaagaaggatggaaagaagcgcaaacgcagccgcaaggagagctactctgtgtatgtgtacaaggtgctgaagcaggtccaccccgacaccggcatctcttccaaggctatgggaatcatgaactccttcgtcaacgacatctttgagcgtatcgccggagaagcgtcacgcctggcgcattacaacaagcgctcgaccatcacttcgagggagatccagacggccgtgcgcctactgctacccggggaattggccaagcacgccgtgtccgagggcaccaaggccgtcaccaagtataccagctccaagtga

SEQ ID NO: 29061 - DNA, 473 bp, Homo sapiens
cttgatgtaaactatattacatctgtaaaaaggtacctgtgactgtatatcaacataaagaagatgaccacctagattttatgattttagtgattataaattatgtaattgccttccctaaatacctccttaatccactgtggtagactgaataatgctactcccttccaaaaatgtccacaccctaatcctcagaatctgttaatgttaccttatatggcaaaagagatcttgtcagtgggattaaattaagaatgttgatgtcgaggagatattcctggattattcaggtgggtcccaaatataatcatgagggtcctcctaagagagagcagatgatcagagtgtatcagagaagatgtgactgcagtagcaaactctttgtgatatgctttgaagatgagaaaaaggcactggccaaggaatacaggggacttagaggagctagaaaaaacaaagaaatggaatccctc

SEQ ID NO: 29062 - DNA, 511 bp, Homo sapiens
gtaaaaatgccctcacattcaaagggttggccaccactgatttaaggtatctactcaccttctagatttcttaaatgcactgtcatcaaccagcttagaacattgctaagtgtatagtaagctctcaattattaccttatttcttaataactattatcttttaattttgtcttatttagtaggaagcctactgaagttctgttgagatctatctatatataaaaatgtgtgtctcacacacatacacatacctatataagttatatatgtgtataataaattcttacttaactttgctgataggttcttggaaacagtaagtgaagcaacatattaagtaaactaatttttaccagaatttaatacaagagttatgtttgcatgacatatagcaacaatgttcatttaaagatgcacttttcatgaacctattttgaacataaagtgaggacttactgtacatacatgtgcaacctggatttttctgataaataaaaattgtataatgtgt

SEQ ID NO: 29063 - DNA, 776 bp, Homo sapiens
cggcttttgcttgtagctccagccagagctcggttagggcctcatcgctctgctcccgctccttagggaagcctcggtgattctgccacagcctcagcctctgtggctctgtgacctgccggtattggatgattcgtatctaagactctgggacactcctgaagtcgggaaatgacggagtcttcgctgtgtcgccaggctggagtgcagtagtgcgatctcggctcaccgcattctccacctcccaggttcaagcgattcacctgctcagcctcctgagtagttgggattacaggcgcgccaccacactcagctaatttttttgtatttttagtagagacggggtttcgccatgttggccaggatggtctccatcttctgacctcatgatccaccggcctcggcctcccaaagtgctgggattataggcgtgagccaccgtgcctggctgaaggttttctcatttcacccaaaactttggacagtgcaggcatagaagattcattccacaaattataccaaaaggaccatgagaaagtggacatgagaatttaagaaaaaacttgtgaaaagtataacatgagtgtaaggtggcgaacggtggttataatagaaattaaccaatggtttattaattactcagaaaaaaacaattcattctattatttgtgtcaaaggttctcataaatttccaattcaaacaaagattagatagaatacggggataaccttactggcggatggggcccattcagggcccacggctaataaaaaga

SEQ ID NO: 29064 - DNA, 751 bp, Homo sapiens
  misc_feature (731)..(731): n is a, c, g, or t
  misc_feature (739)..(739): n is a, c, g, or t
cggcttttgcttgtagctccagccagagctcggttagggcctcatcgctctgctcccgctccttagggaagcctcggtgattctgccacagcctcagcctctgtggctctgtgacctgccggtattggatgattcgtatctaagactctgggacactcctgaagtcgggaaatgacggagtcttcgctgtgtcgccaggctggagtgcagtagtgcgatctcggctcaccgcattctccacctcccaggttcaagcgattcacctgctcagcctcctgagtagttgggattacaggcgcgccaccacactcagctaatttttttgtatttttagtagagacggggtttcgccatgttggccaggatggtctccatcttctgacctcatgatccaccggcctcggcctcccaaagtgctgggattataggcgtgagccaccgtgcctggctgaaggttaatttttcttttagtcatattttccatgcactgtttagaagtactggacgttatatacaaagtgcccaccaggcttcacttgagagaaaaacctttcttctcaggattccagccacaacccacaattgtatgacaaagtgcagcaaggtgctccccaaatctgcaaacaaaatagtctctctatttgggatctacagtcccttctagagcagttagactagatttctacaaaaatcacttcaggacagcaatcagttatttcacctccttcagngctcctgncatcttcagatc

SEQ ID NO: 29065 - DNA, 407 bp, Homo sapiens
  misc_feature (312)..(312): n is a, c, g, or t
cggcttttgcttgtagctccagccagagctcggttagggcctcatcgctctgctcccgctccttagggaagcctcggtgattctgccacagcctcagcctctgtggctctgtgacctgccggtattggatgattcgtatctaagactctgggacactcctgaagtcgggaaatgacggagtcttcgctgtgtcgccaggctggagtgcagtagtgcgatctcggctcaccgcattctccacctcccaggttcaagcgattcacctgctcagcctcctgagtagttgggattacaggcgcgccaccacatctntactaaaaatacaaaaattagcctggtatggttgtgcgcacctgtaaatcccagctacttgggaggctgaggtaggagaattgcttgaccccagg

SEQ ID NO: 29066 - DNA, 220 bp, Homo sapiens
  misc_feature (216)..(216): n is a, c, g, or t
cggcttttgcttgtagctccagccagagctcggttagggcctcatcgctctgctcccgctccttagggaagcctcggtgattctgccacagcctcagcctctgtggctctgtgacctgccggtattggatgattcgtatctaagactctgggacactcctgaagtcgggaaatgaactcttaacattcaaggatgtggccatagaattctctccanaaga

SEQ ID NO: 29067 - DNA, 1394 bp, Homo sapiens
cggcttttgcttgtagctccagccagagctcggttagggcctcatcgctctgctcccgctccttagggaagcctcggtgattctgccacagcctcagcctctgtggctctgtgacctgccggtattggatgattcgtatctaagactctgggacactcctgaagtcgggaaatggtgagtgtgcagggcagggcgtcccaaggctgtggaggcctcatcggaaccggcgggaaatggcggcggtgggaggagtctgtgaatggagcccgctcagccctctgtcctcagtcccctccggtgagggacccgcgctcttgtcagtccccgtacagcggctctggcccagcctgcagccctccttgtgcagctctgcgccggtagccctgcacccccgggctgtggagtgagtaggagctcatccggaagacaccgcggcggcctgcgcggtgccggcgtgggaggagctgtggtccggaatcccgtccctactttaccctgttcagaatgagattgaggccccatcaaaacatggagttcatgtgagcaaacaggacttattaatgggaaagctctgccgtggctcgtggtttggggactgccagcgggtcttgaaggaaaggcttttgtgaggtgtgtgaggaagcgaagcaaatcacctgcctgcgccaactttgccgccagtccccttgccctgtgcgcctcctccgcgtggctgttcctgaatacgctggtgtctgttcgcatcttttagaatacgctggtgtcggtgcgcacagcgcttctcttagttctacggagtcttcgctgtgtcgccaggctggagtgcagtagtgcgatctcggctcaccgcattctccacctcccaggttcaagcgattcacctgctcagcctcctgagtagttgggattacaggcgcgccaccacactcagctaatttttttgtatttttagtagagacggggtttcgccatgttggccaggatggtctccatcttctgacctcatgatccaccggcctcggcctcccaaagtgctgggattataggcgtgagccaccgtgcctggctgaaggttttctcatttcacccaaaactttggacagtgcaggcatagaagattcattccacaaattataccaaaaggaccatgagaaagtggacatgagaatttaagaaaaaacttgtgaaaagtataacatgagtgtaaggtggcgaacggtggttataatagaaattaaccaatggtttattaattactcagaaaaaaacaattcattctattatttgtgtcaaaggttctcataaatttccaattcaaacaaagattagatagaatacggggataaccttactggcggatggggcccattcagggcccacggctaataaaaaga

SEQ ID NO: 29068 - DNA, 1340 bp, Homo sapiens
cggcttttgcttgtagctccagccagagctcggttagggcctcatcgctctgctcccgctccttagggaagcctcggtgattctgccacagcctcagcctctgtggctctgtgacctgccggtattggatgattcgtatctaagactctgggacactcctgaagtcgggaaatggtgagtgtgcagggcagggcgtcccaaggctgtggaggcctcatcggaaccggcgggaaatggcggcggtgggaggagtctgtgaatggagcccgctcagccctctgtcctcagtcccctccggtgagggacccgcgctcttgtcagtccccgtacagcggctctggcccagcctgcagccctccttgtgcagctctgcgccggtagccctgcacccccgggctgtggagtgagtaggagctcatccggaagacaccgcggcggcctgcgcggtgccggcgtgggaggagctgtggtccggaatcccgtccctactttaccctgttcagaatgagattgaggccccatcaaaacatggagttcatgtgagcaaacaggacttattaatgggaaagctgtgaggtgtgtgaggaagcgaagcaaatcacctgcctgcgccaactttgccgccagtccccttgccctgtgcgcctcctccgcgtggctgttcctgaatacgctggtgtctgttcgcatcttttagaatacgctggtgtcggtgcgcacagcgcttctcttagttctacggagtcttcgctgtgtcgccaggctggagtgcagtagtgcgatctcggctcaccgcattctccacctcccaggttcaagcgattcacctgctcagcctcctgagtagttgggattacaggcgcgccaccacactcagctaatttttttgtatttttagtagagacggggtttcgccatgttggccaggatggtctccatcttctgacctcatgatccaccggcctcggcctcccaaagtgctgggattataggcgtgagccaccgtgcctggctgaaggttttctcatttcacccaaaactttggacagtgcaggcatagaagattcattccacaaattataccaaaaggaccatgagaaagtggacatgagaatttaagaaaaaacttgtgaaaagtataacatgagtgtaaggtggcgaacggtggttataatagaaattaaccaatggtttattaattactcagaaaaaaacaattcattctattatttgtgtcaaaggttctcataaatttccaattcaaacaaagattagatagaatacggggataaccttactggcggatggggcccattcagggcccacggctaataaaaaga

SEQ ID NO: 29069 - DNA, 993 bp, Homo sapiens
cggcttttgcttgtagctccagccagagctcggttagggcctcatcgctctgctcccgctccttagggaagcctcggtgattctgccacagcctcagcctctgtggctctgtgacctgccggtattggatgattcgtatctaagactctgggacactcctgaagtcgggaaatggtgagtgtgcagggcagggcgtcccaaggctgtggaggcctcatcggaaccggcgggaaatggcggcggtgggaggagtctgtgaatggagcccgctcagccctctgtcctcagtcccctccggtgagggacccgcgctcttgtcagtccccgtacagcggctctggcccagcctgcagccctccttgtgcagctctgcgccggtagccctgcacccccgggctgtggagtgagtaggagctcatccggaagacaccgcggcggcctgcgcggtgccggcgtgggaggagctgtggtccggaatcccgtccctactttaccctgttcagaatgagattgaggccccatcaaaacatggagttcatgtgagcaaacaggacttattaatgggaaagctctgccgtggctcgtggtttggggactgccagcgggtcttgaaggaaaggcttttgtgaggtgtgtgaggaagcgaagcaaatcacctgcctgcgccaactttgccgccagtccccttgccctgtgcgcctcctccgcgtggctgttcctgaatacgctggtgtctgttcgcatcttttagaatacgctggtgtcggtgcgcacagcgcttctcttagttctacggagtcttcgctgtgtcgccaggctggagtgcagtagtgcgatctcggctcaccgcattctccacctcccagagacggggtttcgccatgttggccaggatggtctccatcttctgacctcatgatccaccggcctcggcctcccagctctcagggaggctaagaggcgggaggatagcttgagcccaggagttcgaga

SEQ ID NO: 29070 - DNA, 611 bp, Homo sapiens
gactttttttctgtgtttgcagtctcttagtagattgcctgtgatgcacatcacattttggtttaattatataacaaaacattttcttgctgttctattatggtggaaaatttttttaggattggagataatttttctctttttttttttttttaagacggagtcttcgctgtgtcgccaggctggagtgcagtagtgcgatctcggctcaccgcattctccacctcccaggttcaagcgattcacctgctcagcctcctgagtagttgggattacaggcgcgccaccacactcagctaatttttttgtatttttagtagagacggggtttcgccatgttggccaggatggtctccatcttctgacctcatgatccaccggcctcggcctcccaaagtgctgggattataggcgtgagccaccgtgcctggctgaaggtttgtgaataatttttgtgatatccactaccacagataagtaaaaatgccctcacattcaaagggttggccaccactgatttaaggtatctactcaccttctagatttcttaaatgcactgtcatcaaccagcttagaacattgctaagtgtatagtaagctctcaattatta

SEQ ID NO: 29071 - DNA, 1889 bp, Homo sapiens
  misc_feature (1032)..(1032): n is a, c, g, or t
tggtgagggaagagagagaccctctcatattgttttatactcagaaaagaaaagagaagcaaaactaaaggcaggtagcctggcacctaggaacagacccaaaaccaaggaaccagacccgaaaccaggcctgggcctgcctgacctaagcctagtagttaaaattctacccctgacctagcaactgatgttatctctagattatagaaagacattgtaaaacttcccggtctgttctatttcactctgaccaccgttgcatgcagcccctgtcacgtaccccctgcttgctcaatcgatcatgaccctctcacgcggaccccccttagagttgtgagcccttaaaagggacaggaattgctcactcggggagctcggattttaagacactagcctgctgatgctcccagctgattaaagccactcccttcactatcttggtgtctgaggggttttgtctgcggcttgtcctgctacatttcttggttccctgaccaggaagcgaggtgattaacggatggttgaggcagctccttaggcgactttagcctgccctgtggaacatccctgcgggggactccaaccagccaaagcaacgcggatcctgagagtgctcctgggtaggcacttgccctgatgggacgccttgccagagcagtgtgtggcaggcccccgtggaggatcagcacagtggctgaacaccaggaaggaactggcatttggagtctggacatctaaaacttggtaagacttgtctttggaacttgcccactccatctgagtggaagcatggcctgatcatccacggtgtgcctttatcggcactttggttttggttttgacatggtttgaattccttgacagggttggtcttgggaatttgcctctaccatttgagcggaagcatggcctgatcacccatggcgtgcctgtaccggcactttggtttttgtttttgacttgacttgggttgcttgatactttggttttggttttgacctggcttggatttctggatactctgattttggntttgattttggtttggtgtaaactgcaaaagtgtgtgtgtgccctttttacctgttctttgttttgtgcgtgtggtgtgagcgtggtgttttgtctcaaagaagcatgggtcaggaacaaataagcccaccctactaggaactatgttgaaaaatttcaagaaaggatttaagggagattacggtgttactatgacaccaggaaaacttagaactttgtgtgaaatagactggccagcattagaggtgggttggccatcagaaggaagcctagacaggtcccttgtttcaaaggtatggcacaaggtaacctgtaagccaaggcacccagaccagtttccctacatagacagttacagctggttttagacccccttccccgccacagtagttaagagaacagcagcataagcggctggcagaggcaaggaaagaccagcagagacaaagagaggaaaagacaggaagagacagagagacaaagaaggagtcaagaaaagagaaagagagacagagaaagagagaggcagaaagaggaagagacagaggcaaaaggaaagtcagagagagagagacagaaagtcaaagagagaaaaagagaaagaaatatacaagtacttaagaaaaaaacagtataccctattcctttaaaagccaaggtaaatttgaaacctataattgataattaaaggtattcttcgtaaccctgtaacactctaataccactttgttgtcagtgtagtcagtgtaaacaagggcgtatcccgaaagcactgaggccttcctatcaaaaatccttaacccagtaacccgcagatggcccagatgcattcaatctgtagtggcagctgctttgct

SEQ ID NO: 29072 - DNA, 854 bp, Homo sapiens
tcggactatatgatcccatttaggagacaattgggaaaagggaaaatccaggggtgaagaatagatctgtggtggcaggggtgggaaaagcggggaggatttgcctactgaggggcagcacaagagaattttgcggggcgatggatctgtctgtatcttgaccatagtgatgatacatgactgtgcatttgtcagaactcacaggactgaatgaaaagagaagtgaattttactgcatgtgaattgttaaaataaatgctagacagtattttaaaaatcaagcccagatcctgcaagacattatggctccccaccagaaggggagagacggggaaagagaagtgtccccaaagttaacccacgttccctgggacccacctccctccccactgccacttcccaccagcctcacgcacgggccaggcccttccctttgcagctcacagcccagcagatgttaggtcagaatgcgtcccctcacttgactaaaggtttacagccagcagggtggaaatgaaccagatattaacaccccctcctccatgccctgcccaccttctggccagtaccagtgaagcagaagccactctcccacccccaggctgtcccaaagccctgaagacccaagaaagcagagccaagtggagtgaccctgataccagggccagctgcccagtcccctgtagctggggaggaccccctcttcttgtgaggcagacactgggagtgacccctccctgcaagggagatttctcatcccccagggttcccagagggttcccagaggaaatacaggatacccaatacatttgaatttcagataaaaaataaataacgttctgatacaagtctgt

SEQ ID NO: 29073 - DNA, 1173 bp, Homo sapiens
  misc_feature (4)..(4): n is a, c, g, or t
  misc_feature (6)..(6): n is a, c, g, or t
ttcngncaagaaacccaaacccaatgagccattgttcagtcccaattaattcctttaagaaaatatgatttgcccatttttagtgatgtggcaaaggctgcaaggaacacactttaaactcactgtggcaaaggcccactcttgtgtgtacatggttttagagtatccctaaaataatatcctatcacatataatcatattacatacaatcatgatgccaaatatttgcctaatacattatgctggcataattgctttcatataatttatctttgattctgttggcaagtgcatgacttcagtagcatgggtgcatagaggtagtactagaagcagagcagtggaccccaacctttttggtaccagggaccaatttagtggaagacaatttttccacagactgggttgggaatagtttcaggatgattcaagtgcattacatttattttgcactatatttttattattattacattgtaatatataatgaaataattatacaactcaccataatatagagtcagtgggagccctgagcttgttttcctgccactagacagttttatctgggggtgatgggagatagtgacagtctgatgatctgctgatctgacaggaggtggagctcaggcggtaatgggagtgatgtggagtggctataaatacagatgaagcttcgctcccttgcctgacattcacatcctgctgttgcaacccaagtcctaacaggccactgaccagtactggttcatggcccaggggttggggacccctggactagaggaaaatgctgtagagaaagaagctgatgtttagagagattgagttgcttagccgaggtcactgcagcaagtcaagtccttcaaggtaaactcatttcaagggatacatttaagggtggggacataatccatttcttgccaacaggacacaaaaatgtctactggagggcttctgggaaaggtttccttgctaaaagtaggagttccaaaagaaaaaaagggagagagagagagatagctcttctttaggtaaatgtcattttgttgaatactaaaggttgagcgttgtcatgttggctcttaatgccccaaattttgtcagtcatcttggaatattgaaggaagctacttagagagataaaagtcaatactcaaaaggtaatagagtgaa

SEQ ID NO: 29074 - DNA, 268 bp, Homo sapiens
tcaaaataaatgcataaaacaatatatgtataatagtgttgagcctataatgcaaacaaaactaatatatttgacattaagagcacaaaagaaataattggagcaaagttgtattaaagaaatgaaatgacactaagatacaacttgaatcaacaggaaaaaaatgaagagaaccagaaattgtaaagaataatgttaacataacaatgctaatagttactttgctttcctttcttctctcatgttctttaaaagacataaaattaca

SEQ ID NO: 29075 - DNA, 360 bp, Homo sapiens
caaacgttgcaatatcctgccttccttcttccttcctaaaggctccagcttttctgggccatacctttccatctccgctaccccatccccacctcctttataaggctgttccactcagggctgctgttggcctttcttagttaccccagggccaggtgacagacaaaagccccagtcaatactccagaccctgctgaaattactcaaactagctcatcctaagccccttgtggtatgtcatgcctcctgcttccagggaactgtgagcttaaacttcttccattatgacagtcatttctgtgtctgtgtctgttgtaaacaaatcctgggtataattaaaataccatgcatcaaactcca

SEQ ID NO: 29076 - DNA, 780 bp, Homo sapiens
gtggcctaaaaaactgaaagcctccatatgcctcttcatcttgccagctacagtccacaaattgtagagcctgcgggcactgtggaagccagctagatttgctctatccagtagcagcagattgagagccatacatggaatttatacttttctagcagccacaggaaaagagtacaaagaagcaggtaaaatttatattacaacatcttttttactgtgtattaaattattattgtaatacctattttaatatataataatgccataatatattttatttaacccaacgtatccaaaatggcatcatttctacaagcgattcctattttaaaaattatccgcaagatattttatgttctttcttttttgtacaaagtctgcaaaatccagtgtgttctttggtcagtgatgtctgagatcccaagttccaatgtctgtctgaaattatgaaaatcaagtcatgggagatggataccctattccctacgatccacttatttcacattgcatgcctgtatcaaaacatctcatgtactccataaatatatacacttactatgtaaccgcaaaaattttaagaatatacaaaaaattttaaaaactgaattaaagagcattgtagataattgtatttttcaaaaaataagtaaaatatctggtatataacagttaaaaaaaaaactgtattatcaactctgtgaccttagaactacctttttacattttcaaagattaactctccttaaaaaaataaatgtacaaattattaccaaaaaaaaa

SEQ ID NO: 29077 - DNA, 435 bp, Homo sapiens
tcagcactgcagtctctgcctctgtcctgcccccaccgcctccactgtggtcaaacttccttctgccttcctggtaaaagaacccctatgattgcacctggccccttagataacccaggttaacctctccagccctcatcacacctacaaagtctcttgtactgtgtaagataacacagccacaggttccagggatcaggacatcttgtggggaagggcattattcagccaaccacatccatggtcaaatgcaaacatgtgaaataaaggcaggaatgtggtgggattggggtgggaggcactcaccctcaaggcctgtgcaagtgcatagctgctcctttctgtattgaaaactttgatcttttgttcatcaaagattttttgcctaatatttattcttaaaagtattacaataaagtgtttatcctagttact

SEQ ID NO: 29078 - DNA, 755 bp, Homo sapiens
gtatggagccaggtacacattttcatgtaaggaactctttgaaaatattgtccagaatgtactcttctaataggaattaaagatgaaaacattgtattaccggacattgtggctagcactgaccctggaggtttgctttgagttgtaaagattttagaatatggacttcagttaaaacctatgctgaatttttctcgtgtaaatgtttgtctttaaaaagtgtgttgtcacagataccatgaataatttgaatttagatgaaaacagcttctggaattatggcaaactagccaaggggcatattagtcatatactggatagtttttcctggaaatctataaattgccttcttaacataaaaataaaggaatagatatggccagattgctcaagtgactccattgctcatgtggttacatgtgcattttgtcagctttgccacactgtaattggctcttctgttggataacttcctagaaagcctaaaataatttagtctatataagtcttatgagtcaatgataccctaagtggaaacacaggtatttaaaaccagccagctttccttttgacttttttttcctgaggcccttctcaggaacgtaactatttttgttaggaagtgcagaaaggagtggtctgttgtttaatgacagaaccactgacatgcaggaggagaccaaagggaaggtgccttagttctaaggaaaaatcttttgtcatttgtacagtgaaagctcattataagagctagt

SEQ ID NO: 29079 - DNA, 406 bp, Homo sapiens
gaaatcgcagcctcagaggtgcggtgacttataaagtcctcagcggagccaggtcctaacccaaacctcctcacctcttttttggcacaaactctgaaagaactttgaaaggttgagaggactgtgtatatcatgcaatctcttgttgctgttgccatgacgatcgtattaaaagtggacccccatgggcactggattgtaacttgaaaatgatgaagataatcaattgtactacagtgttgtaaaaggcctgaaattccgatgcatgctacaacatagatgaacctggagaacatgctaagtaaaattaatcagatacaaaataacaaatgttgtatggttccatgcatttaaggcatatgagtggttgaatgcatagagaaattagaatggtgttcatgatgat

SEQ ID NO: 29080 - DNA, 1073 bp, Homo sapiens
aaaaaaaaaaaaaaaaaaaaaaaacaagcaaatgacatataaaggagctccaattcatctggcaaaagacttcttaacagaagccatataggccaggaggaagtgcagagacattttcaaagtgctgaaattaaaaaaaaaaaaaaactatcatccaagaatactgtatctagcaaagttatccttcaaatatgaaggagagataaagtctttccaagataaacaaaagatgagagaatttaccacaacagacttctaagaaaggttcaagggagtttccaatgtgaaagaaaaagctactaatgtgcaaaatgaaagcttctgaaactgtaaaacccagtggtaaagttaagtacacagacaaaccaagaatagtattgtaattgtgatgtgcaatccactcataactagtatgtagcccaaaagaaatctatcaaaaagaataatagcaagagcaatttgttaagaaataggtaatataaaaatatgtacattgagacaaccaaaaatcaaaaggtgggacggatgggagttaagtgtagaagtgtttcttcttttcatttttctttgtttctattacttgtaatctaagataagttgtcatctctttaaaataacctgttatatctataaaatgtattttgtaagctttatggtaaacacaatacaaaaacctataatagattcactaaaagtaaaaagcaacaaattaaaacatactgttaaccacaaaggaagacagaaaaatgaagactcttaaatatttaagcaaaaaaagaagacagtaagaaaggaagaaagaaagggaggagttacaaaacaaccagaaaacaagcaacaaatggcagtagtaagtccttactaatcaataataacactgaatgtaaattgactcatcctctgattaaaagacataaagtggctgaatggatagagaaacaagacccaactatatgctgcctgcaagaaacccacttcacctgtaaagacacacatagtctaaaagtgaaggggtggaaaaagacatagcttgcaacaggcaacgaaaaaagagcaggagtagctatacttgt

SEQ ID NO: 29081 - DNA, 974 bp, Homo sapiens
catagcaaaattcaagcgagtgagtgtgtgtgcctgcgtgtgtctcagtgacgtgggaaggaatggcagatgctacaacagtgcagactcggcaccccatttatagaatgttctttttatatactatggaggaatctccactcaccttccactccacgtggtccctgtctcctgtccttgggacagagcagatccatttatattctcacatacaaccggatggatagccattccttttcttaatttgattcctgccaacaccctaaccgtcatgacttcaccttttaccatgggtggcttattaaaaacattttcctggacgaagacagttccctccccaagcggaattcgagtgccatctcttaaggtgatgcatttttaattcccactgcacaagccaggcatcacaatgaccatattcaccactcgttgtcaggggtacaccttttggaaggcagcgtgggctaatgtgaatggtactagtctgagtcagatccagttcaaatccaggtaacttaaagcttgtgtgacccagggacactttacttcaacttgttaaaccttaattttgtcacctataaatgtgatacataaacaaacttgaatgtgtcgcacttaaccacatgcctggctttccataggttcctttcctcttgcttcccccactgtgagcaacacaagcatcgccttcttgtgatcatggctcagtgccaagggataaaagctggcagacagcagctttacagctgggaaaaagagctgctgggggcagggctggcggtagctcaagcatgctgtggttcaggctaatgactggaaggtcccatccatccttgagattttatgacgctatgtgcaagatctagcgaacgtatttggctaagaaaaatcctggaggagagactgcctcagacaactggggggctggaaagccgacctggaaagcagcctgaccttggatgatttagcacctg

SEQ ID NO: 29082 - DNA, 510 bp, Homo sapiens
gaaatacaataatttgtgcgtgtgtgtggtgggttaagtgtcacatcttcataaaattcaaccctacccccatttcagtcacttgtcagagaggaaagccaagaagccaattccaagagtttagtgtgacatcagtgtctaggtcatctaaatctggccatctttctgccatacctatctaagtcctgtggcaattaacacagtagagctatatttgcataagtaactttatagtctctgtgtatatgctgagcagagctgattcattttacaatcatttgcacttgtcatagagctccttcaatactactacccaaacatgttggacaaagaaaagaagatagacacttttgttttgttgcttgttttctactgattttgtaatactgtattttcaacttcttagcgacattggccccatgttaaaggcctatgtcacacagcctgttgtgaataagaagttttttttaacagttgcccttgcaataataaacttctatttgcattgaa

SEQ ID NO: 29083 - DNA, 393 bp, Homo sapiens
ggaatgagaaaaatcattctcagtcttttactgtgggtttcaggttgaggccatcaaaaatttcaaggcctagatttaattacaattatctatttgtggtagctactttgaaaaacaaaatcaaagtagttgaagtcaataaaacaatccctggctttcaacttcaggtttggggagcaatgtgtgtgcatgtaaatgtgttgttccctttgctggggggaaatttttacagtgttgggtgtattttatttttatagaagttatgttctctgtgttttatggctttgtttgtttgttttgtcagtttaataccagctttattattaagaagtatttttcttattcttgtaaccactttgtaaaatacatcagaaattttctgtgttttcctaa

SEQ ID NO: 29084 - DNA, 382 bp, Homo sapiens
acacacacacacacacacacagtctcattcagactgggaccgtggagacatgccaaggaacctaagggacatatctctgggaactgaataagaaaccagagtacctgagaaaacccatgcagacatgggaagaacttgcggactccacatggatggtgaccctgaccaggaaccaatttttcttctcatcagtgttataacaaaacaaagttgaattaaacagtgttattcaagggccttctgtgtgcatatgaatgtaaataattcagtcccaagccagaatttggtctcagaatctgggttgcaatcctggcttgaccacttgcatgctggttactgaccattctctctgaactttatctgtaagtctctttatctgtaa

SEQ ID NO: 29085 - DNA, 495 bp, Homo sapiens
caacctcactgccatttgtagagcattacacccaacaactagatacacattcttctcaagtgtacatggtttgttcaccaacataggccacaaacaacaacccttgattaatgtgaaggtattgaaaacatacagaatatgttctcaaataacaaatttaattaaaaatcaataataatagtattataatatacctaggagaaaaagccaagtatctggaaatgaaacaacatacttttaagtaatccataagtgaacagaattcacaagggaaactggaaaatatctcaaaactgaatggcaatgaagagataaagtattcaaatatatgaaatacatgtaaagcagtgcttaagggaaatatgttgctttaaatttatacagatgctccttgacttaccatggggttacatcctgataaacccattgtaagttgaaaatattttaagttgaaaatgtacgtaatatcccaataaacccatcacaaagcaaaaa

SEQ ID NO: 29086 - DNA, 600 bp, Homo sapiens
aaattgtcattatatatgacttgtatggcaaacctggaaactttctctcacaggggttgtctttatttgaagtgactcaagtttgtctggtgcaaaaagcctttggatgtttctcctaaacaattatagacgattgtttagcttcacaaagccgcctcatgtggcattaacagctagggcagacaagaagctcaccaataaatggaaaaggaaaagctgggccatgagatgtcataggggactttgaaaagctccatcgtattcctgggaatctccaaccccactcacacgatcagggctgtgggcatgccagagaagacttgagaaggccctgtgcttttggttcttactgagtaagcaggcagcgaaaaccaaggcagagttgcaaactgcctgcctgggtgatgaaggcatcccctaacaaaaacacagagcccctcgacaaaggctgggaggcttaccagttggaagcatttaaggatatctctgtccattaatgagctgaccactaagctaaccaaacagagacttcagtggccaaacacaacaatgaatatcgaatttaccaaattatttcagcaaaaataagcacaacaaaca

SEQ ID NO: 29087 - DNA, 419 bp, Homo sapiens
gaaaaacaaagccagggcaatcacagttgaacctggatgatgggtacatggaatttcattatgcttttctatctatacttttatatacttgaaattttatagaattaaaaggttttatcttttgttgagaagaggttaccctctgacaccaggctggactgcatttgcacagtcacagcttactccagcctgggcaacagagcaagactccgtctcaaaaaaaataaataaaaataaaaaaaatcccagcactttgggaggccaaggagaaaggatcacttgagtccagggagttcaagagcagcctaggacaacataatgagattccatctctattaaaaaaattaaaaattaggccagggtgtgggtggtatacacctgtaggcgctagtttacttggggagggctgaaccgggggg

SEQ ID NO: 29088 - DNA, 448 bp, Homo sapiens
aatgaacttcaactgtggagtaagaaatatcttagccaccttgggtaagtcaatcagcttctctgtcaatactcttatatacgatgcctgcttgttcccaaccgcagtttgtaaagaaaaatggaataggaagcagaatgcttttggaattctcacaagtaagctattccttcttttccccctcttaaattccctttatcttaaaaagaataatgttctatgaaatgcaatgcaaaatgcaataacatttgagatgttatttttgagttattgcttttttatttctcttaaatgtatatttatttcaacattttaaaaaaatttcctaagccggtcgtggtggctcacgtctgtaatcccaaaactttgagaggtagaggcggctggatcacttgaggtcagcagttcaagtccaccctggccaatatggcgaaaccgcatctctact

SEQ ID NO: 29089 - DNA, 1167 bp, Homo sapiens
  misc_feature (248)..(248): n is a, c, g, or t
  misc_feature (850)..(850): n is a, c, g, or t
  misc_feature (897)..(897): n is a, c, g, or t
  misc_feature (924)..(924): n is a, c, g, or t
  misc_feature (962)..(962): n is a, c, g, or t
  misc_feature (1092)..(1095): n is a, c, g, or t
atgagcgccccctcgacgctgccccccgggggcgaggaagggctggggacggcctggccctctgcagccaatgccagtagcgctccggcggaggcggaggaggcggtggcggggcccggggacgcgcgggcggcgggcatggtcgctatccagtgcatctacgcgctggtgtgcctggtggggctggtgggcaacgccctggtcatcttcgtgatccttcgctacgccaagatgaagacggctaccancatctacctgctcaacctggccgtagccgacgagctcttcatgctgagcgtgcccttcgtggcctcgtcggccgccctgcgccactggcccttcggctccgtgctgtgccgcgcggtgctcagcgtcgacggcctcaacatgttcaccagcgtcttctgtctcaccgtgctcagcgtggaccgctacgtggccgtggtgcaccctctgcgcgcggcgacctaccggcggcccagcgtggccaagctcatcaacctgggcgtgtggctggcatccctgttggtcactctccccatcgccatcttcgcagacaccagaccggctcgcggcggccaggccgtggcctgcaacctgcagtggccacacccggcctggtcggcagtcttcgtggtctacactttcctgctgggcttcctgctgcccgtgctggccattggcctgtgctacctgctcatcgtgggcaagatgcgcgccgtggccctgcgcgctggctggcagcagcgcaggcgctcggagaagaaaatcaccaggctggtgctgatggtcgtggtcgtctttgtgctctgctggatgcctttctacgtggtgcagctgctgaacctcntcgtgaccagccttgatgccaccgtcaaccacgtgtcccttatcctnagctatgccaacagctgcgccaacccnattctctatggcttcctctccgacaacttccgccgatncttccagcgggttctctgcctgcgctgctgcctcctggaaggtgctggaggtgctgaggaggagcccctggactactatgccactgctctcaagagcaaaggtggggcagggtgcatgtgccccccactnnnntgccagcaggaagccctgcaaccagaacccggccgcaagcgcatccccctcaccaggaccaccaccttctga

SEQ ID NO: 29090 - DNA, 416 bp, Homo sapiens
gcagaggttgcagtgagccgagattgcactactgcactccagctgggcaacagtgagactccgtctcgaaaaaaacaaacaaacaaaagcctcagtgaatgtaagctgattcaatttgtagaaagtatgatctctggccaggtgcggtggctcacgcctgtaatcccagcactttgggaggctgaggcgggcggatcacgaggtcaggagatcaagaccatcctggctaacatggtgaaaccccttctctactaaaaatacaaaaaatcagctgggcatggtggcgctcacctgtagtctcagctactcaggaggctgaggcaggagaatcacttgaacccgggaggatgaggttgcagtgagccgagatggtgtcactgcactccagcctggctgagagagcgagactccatctc

SEQ ID NO: 29091 - DNA, 946 bp, Homo sapiens
agatggagtttcgctcttgttgcctaggctggagagcagtggtgcgatcttggctcactgcaacctccacctccctggttcaagtgattctgctgcctcagcctcccaagtagctgggattacaggcgcccgccaccatgcccggtggcgtgcatggtaatttttgtatttttagtagaaacaggatctcgccatgttggccaggctggtcttgaactcctgacctcaggtgatccacccgccttggcctcccaaagtactggggattacagatgtgagccaccacgcctggcccacagtctgtattttaacaagatccccacctcagtcttaggcacatggattctcctcaacccccaataccacagagtctattaatttttacccaatagggaaggggaaaaagtcaagaaagaataatgaattaagtaatctttccccctccaggaagctctttatttaatttcgctcccatgaaacacaatttgaagagtctctcaaataaacaaattccattttctgataattatttaattgccccacttttgaaatttttgtcaaagacgactgtcactccctgtcagaacttctattcagcacagtataccaagcgtttctccatcgagttgttataatatgatcaaaaagcagggagagatgctgcttggttaccctgtggggccttatcggggctcagtgcagtctttccatgtaggcattctcaaatactcaattgaaacctgattgaggatcatttgatctctgttggccctagtgcagtaggctgctgagaaccactgatgcaatagactgagagactaactgcctgcttccctgtcagcccaggctctgctaaggccgtcttagttacagaagaaagtggggcagagagccctgcaaggattacattccattcctaacggagacaggcaagcgttcagtgccc

SEQ ID NO: 29092 - DNA, 484 bp, Homo sapiens
ttttttttttgagatggagtctcgctctgtcacccaggctggagtgcagtggtgtgatcatgactcactgcagcctctgcctcccgggttcaagtgattctggtgcctcagcctcccgagtagctgggactacaggaataagccaccacgcccagctaatttttttgtatttttagtagagatggggtttcgccatgttggccaggctatcctcgaactcctgacctcaggtgatctgcttgcctcggcctcccaaagtgctgggattacaggcatgagccgccacgcctggctctaatatttttatataaggcctgagatgggaaaaactgaagtcatacagtattcactgaccaagagcggcgagcagagaaagaaggcagggaaggaagatggaataagaaaattacctacacagtccatccctgcttctcccatctccatacacccagagggtctttcccaattccatgctttggtacgt

SEQ ID NO: 29093 - DNA, 568 bp, Homo sapiens
cctgttataaacatctgtacctgaaatggtaaaaaatgtaaagtgtttatacttttcttatttaccagttcactggaaaatacatttttatggattaccacctcctctgatgctgccaggtgaatgaggagttagctacagtaataaggtggtaacacagttgattggttatatctaacactatttgtgtggtaccaaaagcacttgtacatatgaagcataatatattttaaaattatttattttaactgcatctgaaatagaaggaaaaaaggaggtttttgagccctagcattaatgagctagggccttcataattaaaaaagtgacctagtgagctgtacctattaggcatcaaatattttaatttttttccatgtgataacagacactttcatttctccttttctgtaatttttctcctgttccttaatacttcttttattttattaaaggaaattcatctcaaggtaaaggtttacttattggactatgttataagatagcaagataatagggaaatggtgtttccagtagaatttttgctaaacaaaatttacatgtctcc

SEQ ID NO: 29094 - DNA, 2308 bp, Homo sapiens
  misc_feature (1348)..(1348): n is a, c, g, or t
  misc_feature (1651)..(1651): n is a, c, g, or t
agcagctccaggctggatctgcgccggacacaggagaaagcagcgggtaggctaagcaggggtgctgaggatggaggaaagttgggaggctgagcacagctgaagtcctgagctccctgtgcccttgacttctctgtgggctcgagcaaggaccatcccaactcaggatgaaccctccttcggggccaagagtcctgcccagcccaacccaagagcccagctgcatggccaccccagcaccacccagctggtgggacagctcccagagcagcatctccagcctgggccggcttccatccatcagtcccacagcacctgggacttgggctgctgcctgggtccccctccccacggttgatgttccagaccatgcccactataccctgggcacagtgatcttgctggtgggactcacggggatgctgggcaacctgacggtcatctataccttctgcaggagcagaagcctccggacacctgccaacatgttcattatcaacctcgcggtcagcgacttcctcatgtccttcacccaggcccctgtcttcttcaccagtagcctctataagcagtggctctttggggagacaggctgcgagttctatgccttctgtggagctctctttggcatttcctccatgatcaccctgacggccatcgccctggaccgctacctggtaatcacacgcccgctggccacctttggtgtggcgtccaagaggcgtgcggcatttgtcctgctgggcgtttggctctatgccctggcctggagtctgccacccttcttcggctggagcgcctacgtgcccgaggggttgctgacatcctgctcctgggactacatgagcttcacgccggccgtgcgtgcctacaccatgcttctctgctgcttcgtgttcttcctccctctgcttatcatcatctactgctacatcttcatcttcagggccatccgggagacaggacgggctctccagaccttcggggcctgcaagggcaatggcgagtccctgtggcagcggcagcggctgcagagcgagtgcaagatggccaagatcatgctgctggtcatcctcctcttcgtgctctcctgggctccctattccgctgtggccctggtggcctttgctgggtacgcacacgtcctgacaccctacatgagctcggtgccagccgtcatcgccaaggcctctgcaatccacaaccccatcatttacgccatcacccaccccaagtacagggtggccattgcccagcacctgccctgcctgggggtgctgctgggtgtatcacgccggcacagtcgcccctaccccagctaccgctccacccaccgctccacgctgancagccacacctccaacctcagctggatctccatacggaggcgccaggagtccctgggctcggagagtgaggtgggctggacacacatggaggcagcagctgtgtggggagctgcccagcaagcaaatgggcggtccctctacggtcagggtctggaggacttggaagccaaggcaccccccagaccccagggacacgaagcagagactccagggaagaccaaggggctgatccccagccaggaccccaggatgtaggacgcccactggctctccctttcttctgagacacatccagccccccnacgtctccctcatatacacagacccaggattatgctgtgagcctgcaggctttggaagtggccctgtcacccgtgctgcacgggattcacagccccagccccatggcccctctccacacctcaaaactcctgccccataacgtcctccgcatccactttccagctcagcagccgcacccgaggctcagcctgaggggtgtgtgcccaggccctcccacttcccgagttgtctgcctctcctcaaatgctgtgtgctgcaattgtccaggcgatgacaatggtgatggctccagagaacacaccagctatttatgagcctctgcccccaggctgggcctgtcactggcataggaaggccagccccgcatctcccactgccaacagctgaagccgagcacagacctccctttgcacgctggaacagttactcacctgtggcttcttcccccagtgtaccgttccactgtggcccacattcttgtgcacgcgggcatttgcaggcacgctctcgcgtagttacctatctgaatgcacaccaagcacatgcgtgcacactctgcgtctgtgattcatttcatgtagtggtctaagctcctcccagggctgtgtggatctgacagggtataggaaaataaaaagcggagaaggtgtcttcag

SEQ ID NO: 29095 - DNA, 2341 bp, Homo sapiens
  misc_feature (1381)..(1381): n is a, c, g, or t
  misc_feature (1684)..(1684): n is a, c, g, or t
agcagctccaggctggatctgcgccggacacaggagaaagcagcgggtaggctaagcaggggtgctgaggatggaggaaagttgggaggctgagcacagctgaagtcctgagctccctgtgcccttgacttctctgtgggctcgagcaaggaccatcccaactcaggatgaaccctccttcggggccaagagtcctgcccagcccaacccaagagcccagctgcatggccaccccagcaccacccagctggtgggacagctcccagagcagcatctccagcctgggccggcttccatccatcagtcccacagcacctgggacttgggctgctgcctgggtccccctccccacggttgatgttccagaccatgcccactataccctgggcacagtgatcttgctggtgggactcacggggatgctgggcaacctgacggtcatctataccttctgcagagctgtgcttcgtggagtcactgtgatgatgcagagcagaagcctccggacacctgccaacatgttcattatcaacctcgcggtcagcgacttcctcatgtccttcacccaggcccctgtcttcttcaccagtagcctctataagcagtggctctttggggagacaggctgcgagttctatgccttctgtggagctctctttggcatttcctccatgatcaccctgacggccatcgccctggaccgctacctggtaatcacacgcccgctggccacctttggtgtggcgtccaagaggcgtgcggcatttgtcctgctgggcgtttggctctatgccctggcctggagtctgccacccttcttcggctggagcgcctacgtgcccgaggggttgctgacatcctgctcctgggactacatgagcttcacgccggccgtgcgtgcctacaccatgcttctctgctgcttcgtgttcttcctccctctgcttatcatcatctactgctacatcttcatcttcagggccatccgggagacaggacgggctctccagaccttcggggcctgcaagggcaatggcgagtccctgtggcagcggcagcggctgcagagcgagtgcaagatggccaagatcatgctgctggtcatcctcctcttcgtgctctcctgggctccctattccgctgtggccctggtggcctttgctgggtacgcacacgtcctgacaccctacatgagctcggtgccagccgtcatcgccaaggcctctgcaatccacaaccccatcatttacgccatcacccaccccaagtacagggtggccattgcccagcacctgccctgcctgggggtgctgctgggtgtatcacgccggcacagtcgcccctaccccagctaccgctccacccaccgctccacgctgancagccacacctccaacctcagctggatctccatacggaggcgccaggagtccctgggctcggagagtgaggtgggctggacacacatggaggcagcagctgtgtggggagctgcccagcaagcaaatgggcggtccctctacggtcagggtctggaggacttggaagccaaggcaccccccagaccccagggacacgaagcagagactccagggaagaccaaggggctgatccccagccaggaccccaggatgtaggacgcccactggctctccctttcttctgagacacatccagccccccnacgtctccctcatatacacagacccaggattatgctgtgagcctgcaggctttggaagtggccctgtcacccgtgctgcacgggattcacagccccagccccatggcccctctccacacctcaaaactcctgccccataacgtcctccgcatccactttccagctcagcagccgcacccgaggctcagcctgaggggtgtgtgcccaggccctcccacttcccgagttgtctgcctctcctcaaatgctgtgtgctgcaattgtccaggcgatgacaatggtgatggctccagagaacacaccagctatttatgagcctctgcccccaggctgggcctgtcactggcataggaaggccagccccgcatctcccactgccaacagctgaagccgagcacagacctccctttgcacgctggaacagttactcacctgtggcttcttcccccagtgtaccgttccactgtggcccacattcttgtgcacgcgggcatttgcaggcacgctctcgcgtagttacctatctgaatgcacaccaagcacatgcgtgcacactctgcgtctgtgattcatttcatgtagtggtctaagctcctcccagggctgtgtggatctgacagggtataggaaaataaaaagcggagaaggtgtcttcag

SEQ ID NO: 29096 - DNA, 767 bp, Homo sapiens
caccatctctcaggaacatgaccctttcttttcaaaatggcctgaaaatagagcaaatggccctgttttaaggcatcattacaaagacatctcaaagtctcaacttgtttatccacatgagtttcttaaatgctctgaggcccacttccctcctagggaaaagggaatattggtaaaaatgagcattgataaaaatgagcattgattggaggctccctggcgtaaggtcccgtgcttagcactatccaaggattgtggagtaagttctccaggaagccctctgaggcaggtcccagggccctgggctagatgaaaggcagagctagcattcttcctgggcagtgtgacgctggagtccctgctctgactaccacggtccacagccccctgtagcacccacctcccaccttggaggagttgctgcagggattgacaaagtaacatctagaaagtacttagctggtctgctacggacggacatcccttaaacaatgagagctgctgctgtgagttgagggcttcatcccctgggagggatctgaagagctatgaaggggaggggctaagggaacgtgaaaggggtggccctggttgggggccccatcagctggggtagggcctggaggaacccaggagtaggggtgtaaccagggtgctgtggatggatgcacaggccctgtgcttccatgcagatggctagtccttccgtgcagatgacttagccctcaggagccccttagagcagcagggtctttgccttcccttta

SEQ ID NO: 29097 - DNA, 418 bp, Homo sapiens
ctgtccttagattacaggctcaggtctgagatgctatgaagtaagaaaaaagtgtgctgagaatagaggataaaatttatcaaaattgccaagtcaatttttatcagttttggcagcaaggatcacctggaaatgcaaagcgtgttttcttttttacacagaaaagcaaatattctctaaacattaaaagtttatttacctctcaacttcaattccctatcacagtttcttctacccaaaatgagagaaaagatataacaaggttatcatggatatggtggaatgaagcaaagtcaactttgaaataatttgggatcatatttagatcacaccttattgagtggagatttggttttctccagaagggaatggatgtctcactattcataatcctgtgaagaaatgtttaattctgggc

SEQ ID NO: 29098 - DNA, 383 bp, Homo sapiens
tataaagtagaggtctaatttcatttttttgcatgtggatatccagctattccagcattatcattgaagagactaccttttccccatttattgtcttggtaaccttgaataaagttaaccacaaatgtaagggtttatttctggactttcaattctattccattgatttatatgtttatctttatgtcagtaccatgctgttttgattattgtagctttgtagtaaaatttgaaatttggaactctgagtcctgaaactttgtttttctttttccagatttctttttttttcttctatttttgaccccttgaatttcaaaatgaatgttaggaaaagtatgtccatttctgcaaaaagagcaaagtggtcctttgatgtatat

SEQ ID NO: 29099 - DNA, 378 bp, Homo sapiens
ttcattacagtttagtgaacagtttactaaccataataataatacatttaacttaattatgtatattcaccaaaagtagtaattgagaagattaatcctcctttatttcaagattttactttatttgtatttatttatttgagacaaggtctcactctgtcaccaaggctagagtgcagtgctgtgattataactgactgcagcctcaacctcctgggctcaagagatcctcccactgcagcctccctagtagctgggactacaggtgtgcaccaacacacccagcttattttttattttttgtagaggtgaggtttcaccatgttgcccaggctggccttgaactcttgggctcaaaatatagccttggcctcccaa

SEQ ID NO: 29100 - DNA, 486 bp, Homo sapiens
aaactttattaaacaatcctgatttagaatacatttcttcccccactttcccgtaacttacctcctgcaccgagcagccctaaacttcttttctttggctagtctaagatatacaccccaaatcctaattgcctctttgcatcacatttctttgtgaatttccatgtgtatgtacataattaattgttatttttcttgttaacttgtctgtgatcagtttaatttgtagggtcccagacactgaacctaggatggaagagaaaaagtgtttctgctttcctatggcttaggcaaccatgaatggacaggcagggcatcccacttgctccagaggctgcagctcaattgagatctgacaaagctgatgtgaaaactttactgaaccagatcctggaattttgcctacaaaaatacaaatacagaactctgttttttcttttccaaattcagatttgcacgagaataaaattataagaattaaaaaaa

SEQ ID NO: 29101 - DNA, 523 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaatacca

SEQ ID NO: 29102 - DNA, 406 bp, Homo sapiens
agcgagttcttttcggctggaatggggaatttgtgaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaatacca

SEQ ID NO: 29103 - DNA, 918 bp, Homo sapiens
agcgagttcttttcggctggaatggggaatttgtgaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaagtaagtgcaagacgttataatgaagattacttaaaatatggctttatcaaatgtgaaaaaccctttgaaaatgacagacctcagtgtgttatttgtaataatattcttgcgaatgaaagcttaaaaccttcgaaattaaaaaggcacttagaaactcagcatgctgaacttattgataagcctcttgaatattttcaaagaaagaaaaaagacataaagttatcaacacaatttcttagttgttctactgctgttagtgagaaagccttattatcatcatatttagttgcatatcgtgtggcaaaagagaaaatagctaacacagctgctgaaaaaattattcttccagcatgtttggatatggtgcgtacaatatttgatgataaatcagctgataaattaaaaactatacctaatgataacacagtatctcttcg

SEQ ID NO: 29104 - DNA, 2968 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaagtgttttgcatgaatcctttgcctgaattgtgcacattgcaaggaatgctgaggtcaatttcaatatgcgagaggggtatttgatggaggagatatgatgaatagaatgtatattggctaagaaatggttttcagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaattcttagggtaagtctgaattaaatgttactttcccctcactgggcatggtggctcagacctgtaatccccgcactttggcaggccatggcagaaggctctgttgagcccaggagttcaagaccatcctgggcaacatagtgagaccttatttctactaaaaatattttaaaaataagtcaggtgtggtggtgcacacctatagtcccagctactcaggaggctgtggcaggagggtcgcttgacctcaggagtttgaagttgcagtcatctatgattgcaccactgcagtccagcctgagcaacagagtgaaaccctgtctcgagaaaattaaatgttacttccctaaaaaaaccttttctaaccaccctagggtaaatcctccattattcctttatttctttgttttccttgtagtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttgaaaaacaaaaaa

SEQ ID NO: 29105 - DNA, 2619 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaagtgttttgcatgaatcctttgcctgaattgtgcacattgcaaggaatgctgaggtcaatttcaatatgcgagaggggtatttgatggaggagatatgatgaatagaatgtatattggctaagaaatggttttcagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaaaaaaaccttttctaaccaccctagggtaaatcctccattattcctttatttctttgttttccttgtagtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttgaaaaacaaaaaa

SEQ ID NO: 29106 - DNA, 2236 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaagtgttttgcatgaatcctttgcctgaattgtgcacattgcaaggaatgctgaggtcaatttcaatatgcgagaggggtatttgatggaggagatatgatgaatagaatgtatattggctaagaaatggttttcagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaaaaacaacacaacaaaaaaacaaaaaaaaaaaaaaaaaagaaaaaagacaaaaaacaaaaaaaaaacaagagacacacacacaagcgaccgacgaactccaacaccaacgacaccacacacacacgagcgacccaaaagggagacagcagcaagcacaccaccctcagtcgcaacgaaaaagaagaaaagaaacaatcgacgacgacaaacaagtgaataaacaaatcaggatagctgtgactgcagactctaatagacaaaagagatagaagctgagtacaggaggctgcacgaacaatcgaagggaacacaagccgctaaagaacaggtattgagacgaaaaagaggacggtaacacaatgcggcgagacaagagatgcgcggggaaagaatcacgagcgggacagagacacagacggatagacagagaacaagacaagccgcgcactgaggggcacaccaccgaagagggctggcgagcagagacgggggcaggctataagtcatgaacaagaaaaacgaaggcggacaacaagcagaagagaaagagaagaaagtgagcagagaggaaagagaaggcagccgtctcggaggcaggcggagcatgaggggcagggg

SEQ ID NO: 29107 - DNA, 3035 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtgaggcgaaagaagggcatcctctgatgggagtggaccggagtccgctaaagcgaagcattccagggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaagtgttttgcatgaatcctttgcctgaattgtgcacattgcaaggaatgctgaggtcaatttcaatatgcgagaggggtatttgatggaggagatatgatgaatagaatgtatattggctaagaaatggttttcagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaattcttagggtaagtctgaattaaatgttactttcccctcactgggcatggtggctcagacctgtaatccccgcactttggcaggccatggcagaaggctctgttgagcccaggagttcaagaccatcctgggcaacatagtgagaccttatttctactaaaaatattttaaaaataagtcaggtgtggtggtgcacacctatagtcccagctactcaggaggctgtggcaggagggtcgcttgacctcaggagtttgaagttgcagtcatctatgattgcaccactgcagtccagcctgagcaacagagtgaaaccctgtctcgagaaaattaaatgttacttccctaaaaaaaccttttctaaccaccctagggtaaatcctccattattcctttatttctttgttttccttgtagtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttgaaaaacaaaaaa

SEQ ID NO: 29108 - DNA, 2851 bp, Homo sapiens
agcgagttcttttcggctggaatggggaatttgtgaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaagtgttttgcatgaatcctttgcctgaattgtgcacattgcaaggaatgctgaggtcaatttcaatatgcgagaggggtatttgatggaggagatatgatgaatagaatgtatattggctaagaaatggttttcagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaattcttagggtaagtctgaattaaatgttactttcccctcactgggcatggtggctcagacctgtaatccccgcactttggcaggccatggcagaaggctctgttgagcccaggagttcaagaccatcctgggcaacatagtgagaccttatttctactaaaaatattttaaaaataagtcaggtgtggtggtgcacacctatagtcccagctactcaggaggctgtggcaggagggtcgcttgacctcaggagtttgaagttgcagtcatctatgattgcaccactgcagtccagcctgagcaacagagtgaaaccctgtctcgagaaaattaaatgttacttccctaaaaaaaccttttctaaccaccctagggtaaatcctccattattcctttatttctttgttttccttgtagtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttgaaaaacaaaaaa

SEQ ID NO: 29109 - DNA, 3145 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtgaggcgaaagaagggcatcctctgatgggagtggaccggagtccgctaaagcgaagcattccaggccaaggttaactatttgtaacatgtcatctttcaaggaagcatctaaccaagattaagtcaaaggcatctaccaggtcctgaattctctcccagatgcacaccttttaaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaagtgttttgcatgaatcctttgcctgaattgtgcacattgcaaggaatgctgaggtcaatttcaatatgcgagaggggtatttgatggaggagatatgatgaatagaatgtatattggctaagaaatggttttcagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaattcttagggtaagtctgaattaaatgttactttcccctcactgggcatggtggctcagacctgtaatccccgcactttggcaggccatggcagaaggctctgttgagcccaggagttcaagaccatcctgggcaacatagtgagaccttatttctactaaaaatattttaaaaataagtcaggtgtggtggtgcacacctatagtcccagctactcaggaggctgtggcaggagggtcgcttgacctcaggagtttgaagttgcagtcatctatgattgcaccactgcagtccagcctgagcaacagagtgaaaccctgtctcgagaaaattaaatgttacttccctaaaaaaaccttttctaaccaccctagggtaaatcctccattattcctttatttctttgttttccttgtagtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttgaaaaacaaaaaa

SEQ ID NO: 29110 - DNA, 2313 bp, Homo sapiens
agcgagttcttttcggctggaatggggaatttgtgaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaattcttagggtaagtctgaattaaatgttactttcccctcactgggcatggtggctcagacctgtaatccccgcactttggcaggccatggcagaaggctctgttgagcccaggagttcaagaccatcctgggcaacatagtgagaccttatttctactaaaaatattttaaaaataagtcaggtgtggtggtgcacacctatagtcccagctactcaggaggctgtggcaggagggtcgcttgacctcaggagtttgaagttgcagtcatctatgattgcaccactgcagtccagcctgagcaacagagtgaaaccctgtctcgagaaaattaaatgttacttccctaaaaaaaccttttctaaccaccctagggtaaatcctccattattcctttatttctttgttttccttgtagtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttgaaaaacaaaaaa

SEQ ID NO: 29111 - DNA, 2550 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtgaggcgaaagaagggcatcctctgatgggagtggaccggagtccgctaaagcgaagcattccagggttcgttgcgggaaatacagtctggttttgccccccgtatgaattgagggaaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaattcttagggtaagtctgaattaaatgttactttcccctcactgggcatggtggctcagacctgtaatccccgcactttggcaggccatggcagaaggctctgttgagcccaggagttcaagaccatcctgggcaacatagtgagaccttatttctactaaaaatattttaaaaataagtcaggtgtggtggtgcacacctatagtcccagctactcaggaggctgtggcaggagggtcgcttgacctcaggagtttgaagttgcagtcatctatgattgcaccactgcagtccagcctgagcaacagagtgaaaccctgtctcgagaaaattaaatgttacttccctaaaaaaaccttttctaaccaccctagggtaaatcctccattattcctttatttctttgttttccttgtagtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttgaaaaacaaaaaa

SEQ ID NO: 29112 - DNA, 2493 bp, Homo sapiens
atacatcgtgaaggtttagcatccagagaaattccacagaatctcatggaagtattgaaaaatgcagtgaaagttgttaattttattaaaggaagctcattgaatagccggcttcttgaaacattttgttcagagattggaactaatcatacccacttactatatcataccaaaattcgttggttgtctcaagggaaaatactaagcagggtttatgagctcaggaatgagattcacttttttctcattgaaaaaaaatctcatttggcaagtatttttgaagatgatacttgggtaacaaaattggcatatttaactgatatttttagcattcttaatgaactgagtttaaaactacaggggaaaaacagtgatgtattccaacatgttgaacgtatccagggatttcgaaagacattattgttatggcaagtaagacttaaaagtaatcgtcctagctattacatgtttccaagatttttgcagcatattgaagagaatattattaatgaaaacattttgaaagaaataaaattagagatattgttgcatctcacttctctgtctcaaacttttaaccatttctttccagaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaattcttagggtaagtctgaattaaatgttactttcccctcactgggcatggtggctcagacctgtaatccccgcactttggcaggccatggcagaaggctctgttgagcccaggagttcaagaccatcctgggcaacatagtgagaccttatttctactaaaaatattttaaaaataagtcaggtgtggtggtgcacacctatagtcccagctactcaggaggctgtggcaggagggtcgcttgacctcaggagtttgaagttgcagtcatctatgattgcaccactgcagtccagcctgagcaacagagtgaaaccctgtctcgagaaaattaaatgttacttccctaaaaaaaccttttctaaccaccctagggtaaatcctccattattcctttatttctttgttttccttgtagtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttgaaaaacaaaaaa

SEQ ID NO: 29113 - DNA, 2497 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtgaggcgaaagaagggcatcctctgatgggagtggaccggagtccgctaaagcgaagcattccagggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaattcttagggtaagtctgaattaaatgttactttcccctcactgggcatggtggctcagacctgtaatccccgcactttggcaggccatggcagaaggctctgttgagcccaggagttcaagaccatcctgggcaacatagtgagaccttatttctactaaaaatattttaaaaataagtcaggtgtggtggtgcacacctatagtcccagctactcaggaggctgtggcaggagggtcgcttgacctcaggagtttgaagttgcagtcatctatgattgcaccactgcagtccagcctgagcaacagagtgaaaccctgtctcgagaaaattaaatgttacttccctaaaaaaaccttttctaaccaccctagggtaaatcctccattattcctttatttctttgttttccttgtagtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttgaaaaacaaaaaa

SEQ ID NO: 29114 - DNA, 3088 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtgaggcgaaagaagggcatcctctgatgggagtggaccggagtccgctaaagcgaagcattccagggttcgttgcgggaaatacagtctggttttgccccccgtatgaattgagggaaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaagtgttttgcatgaatcctttgcctgaattgtgcacattgcaaggaatgctgaggtcaatttcaatatgcgagaggggtatttgatggaggagatatgatgaatagaatgtatattggctaagaaatggttttcagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaattcttagggtaagtctgaattaaatgttactttcccctcactgggcatggtggctcagacctgtaatccccgcactttggcaggccatggcagaaggctctgttgagcccaggagttcaagaccatcctgggcaacatagtgagaccttatttctactaaaaatattttaaaaataagtcaggtgtggtggtgcacacctatagtcccagctactcaggaggctgtggcaggagggtcgcttgacctcaggagtttgaagttgcagtcatctatgattgcaccactgcagtccagcctgagcaacagagtgaaaccctgtctcgagaaaattaaatgttacttccctaaaaaaaccttttctaaccaccctagggtaaatcctccattattcctttatttctttgttttccttgtagtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttgaaaaacaaaaaa

SEQ ID NO: 29115 - DNA, 1504 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaagtgttttgcatgaatcctttgcctgaattgtgcacattgcaaggaatgctgaggtcaatttcaatatgcgagaggggtatttgatggaggagatatgatgaatagaatgtatattggctaagaaatggttttcagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaagtaagtgcaagacgttataatgaagattacttaaaatatggctttatcaaatgtgaaaaaccctttgaaaatgacagacctcagtgtgttatttgtaataatattcttgcgaatgaaagcttaaaaccttcgaaattaaaaaggcacttagaaactcagcatgctgaacttattgataagcctcttgaatattttcaaagaaagaaaaaagacataaagttatcaacacaatttcttagttgttctactgctgttagtgagaaagccttattatcatcatatttagttgcatatcgtgtggcaaaagagaaaatagctaacacagctgctgaaaaaattattcttccagcatgtttggatatggtgcgtacaatatttgatgataaatcagctgataaattaaaaactatacctaatgataacacagtatctcttcg

SEQ ID NO: 29116 - DNA, 2566 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtgaggcgaaagaagggcatcctctgatgggagtggaccggagtccgctaaagcgaagcattccagggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgaaaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaattcttagggtaagtctgaattaaatgttactttcccctcactgggcatggtggctcagacctgtaatccccgcactttggcaggccatggcagaaggctctgttgagcccaggagttcaagaccatcctgggcaacatagtgagaccttatttctactaaaaatattttaaaaataagtcaggtgtggtggtgcacacctatagtcccagctactcaggaggctgtggcaggagggtcgcttgacctcaggagtttgaagttgcagtcatctatgattgcaccactgcagtccagcctgagcaacagagtgaaaccctgtctcgagaaaattaaatgttacttccctaaaaaaaccttttctaaccaccctagggtaaatcctccattattcctttatttctttgttttccttgtagtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttgaaaaacaaaaaa

SEQ ID NO: 29117 - DNA, 966 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaagtaagtgcaagacgttataatgaagattacttaaaatatggctttatcaaatgtgaaaaaccctttgaaaatgacagacctcagtgtgttatttgtaataatattcttgcgaatgaaagcttaaaaccttcgaaattaaaaaggcacttagaaactcagcatgctgaacttattgataagcctcttgaatattttcaaagaaagaaaaaagacataaagttatcaacacaatttcttagttgttctactgctgttagtgagaaagccttattatcatcatatttagttgcatatcgtgtggcaaaagagaaaatagctaacacagctgctgaaaaaattattcttccagcatgtttggatatggtgcgtacaatatttgatgataaatcagctgataaattaaaaactatacctaatgataacacagtatctcttcg

SEQ ID NO: 29118 - DNA, 590 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtgaggcgaaagaagggcatcctctgatgggagtggaccggagtccgctaaagcgaagcattccagggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaatacca

SEQ ID NO: 29119 - DNA, 643 bp, Homo sapiens
agcgagttcttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtgaggcgaaagaagggcatcctctgatgggagtggaccggagtccgctaaagcgaagcattccagggttcgttgcgggaaatacagtctggttttgccccccgtatgaattgagggaaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaatacca

SEQ ID NO: 29120 - DNA, 737 bp, Homo sapiens
atacatcgtgaaggtttagcatccagagaaattccacagaatctcatggaagtattgaaaaatgcagtgaaagttgttaattttattaaaggaagctcattgaatagccggcttcttgaaacattttgttcagagattggaactaatcatacccacttactatatcataccaaaattcgttggttgtctcaagggaaaatactaagcagggtttatgagctcaggaatgagattcacttttttctcattgaaaaaaaatctcatttggcaagtatttttgaagatgatacttgggtaacaaaattggcatatttaactgatatttttagcattcttaatgaactgagtttaaaactacaggggaaaaacagtgatgtattccaacatgttgaacgtatccagggatttcgaaagacattattgttatggcaagtaagacttaaaagtaatcgtcctagctattacatgtttccaagatttttgcagcatattgaagagaatattattaatgaaaacattttgaaagaaataaaattagagatattgttgcatctcacttctctgtctcaaacttttaaccatttctttccagaagaaaaatttgaaacattaagggaaaacagttgggtaaaagatccatttgcttttcgaaaccctgaatcaataattgagctaaacttggtgcctgaagaagagaatgagctgaaatgagccgtgtatcctctagagtcagctag

SEQ ID NO: 29121 - DNA, 453 bp, Homo sapiens
agacactgtgcagaataattatgatagctgatatttacatagcccttactctgggccagtcaccagaaggcaggcattgttatttttgtccctagtttatagtgatgaaactgagacatggagtggtcatttcatttgcctaagaaaatagcaggctgggtttgttggctcacacctgtaatcccagcactttgggaggccaaggtgggtggatcacttgaggtgaggagtttgagaccagccttgccaacttagtgaaaccctatctgtactaaaaatacaaaaatgagccaggcatagtggcatgcacttgtagtcccagctgtttgggagactgaggcaggaggttcgcttgaaccagggagtcagaggttgcagtgagccaagattgcaccactgtactccacatcctgggtgacagagtgagactccgtctccaagaaaaaaaaaaaa

SEQ ID NO: 29122 - DNA, 417 bp, Homo sapiens
gataggatttaagatgcagaaagcaaagctgcgactctaaacaataataacaaatatttttttagaacttgataggacaatggtagtaggtgttttacaagcatttccacagttaataaacaaacctcttggtaaagaaggtaagattactctttattttatagaccagcaaaaggtggagttcacagaaactaatttgagaggcaagactttgtctgcatcagcctggttaaaaaaagcactctctacgattttatagtatgctcttacatgtttgaaaaatcttccagactacagacgaactgactaggagaataaagcaacgaagatcagagagccagataaaaatgtaattagtttgtgtttattaataaaccaggagaagtaagcaagtacaataacaaagatactgtaagg

SEQ ID NO: 29123 - DNA, 360 bp, Homo sapiens
catattttgggtagagatggggtttcaccatgttggccaggctggtcttgaactcctgcccttccctaatgtgtggtgcatgttcatgccacccatttgcttctcttcctggggcctagcattccttccgtgggctgctttccttcaactcttcttccttcaggactcagttgagatcgcacctccccaccagacattcttcattgactgtccccatcatagcactgtgcttctacctgtcatttcagagccaagcacggtggcgcacacctgttgtcctagctacttgggaggctgaggcaggaggattgcttgagcctgggaagctgagcctaatctaggcaacagagcaagctcctg

SEQ ID NO: 29124 - DNA, 439 bp, Homo sapiens
taatttgctttccttctcaaaatctgaaatgccttccaagtaaaacttttcacctaacatttaaagctggctgtagtcaggtcagttaccctttcagatcacatctgctgctactcttgcacgcttgcctaatgctccaagcaaacaactacatatacactttcccagaacactcttacctgcatgcttttaaatattcttttttctccttaaattctctccctcattctgaccaatctctaccagataaattctactcatatttcaaaacccagctggaactttacctccctggatgtttttgtgagtcccctgtgtagctgtgatgtctcactgcagcatatatgtcttttatgttgtacttatatttgctttgctcatttgttattgagcacttgtctgttgaaactgattctgtgttgggttttggcagtaacga

SEQ ID NO: 29125 - DNA, 279 bp, Homo sapiens
ttgcattcgatgatgatttcaattgagtgcattcaaatattacattcgattccaatcgatcatgactccattcgtgtccattcgatgattctattccattccattcccatgatgattccattcgatgccattcaatgattccatttgattccattcgttgatgattccattcgagtccattctcagattccattagattccatttgatgatgatttcatttgagtccatttgatgattccagtcgattctattcattgatgagtccattcaagtcccat

SEQ ID NO: 29126 - DNA, 483 bp, Homo sapiens
aagcagaatgcaggaactatatcatctgtgaacccaccattattcagtcataatcactgcaaatattttggagtatatatcttttaaaataaaaacacttaaaaactaggtcacacaggatatataattttgaacctgcttttatgttccttaacattttcaatgagaataatctataatgtaataatttttaatggttgcagagtagtattattatttgctattgaagattcaagttttatctagttttttactgttataaataacattgcaataaagactcttacgctaaaataacattgcaataaagactcttacgccaaaaaaaaaaaaaaaaaaaaagcctggcgtggcatgtgcctatagtcccagctacttgggaggctgaggtgggaggattgcttgagcctgggaggttgaggctttagtgagtcatgaccatgccactgccctccaggctggtgacagagtgagcgcctgtca

SEQ ID NO: 29127 - DNA, 761 bp, Homo sapiens
tcaagctcctggcctcaagtgatttgccaccttggcctcacacgttgctgagattacaggcatgagcaccacacctggccaatggggcgtttcttaaaatagctactagactatgacgtttatcctaaggtttgaagtctatcatcttccttacatatccttcattgtggtatctgggaatgaatcaacaagatgagagagcctccttcattcagtgtggctccttcatttccatgcttcctgaagattaaggtcactgaattttaaaattcaatattctgtgagttacacaccatggagtaactgggagaataatgtaagtttatgatgtaagttgtgcttgtgttccaggtgtccatgaacacgtagagtgccactttgggttgtagaaaataattgcacaaccaactgactgaaataccagtgaggacattgatggaatattaagggtattcatgagaggcaagtgataggttactagggatggattgtgtgggagaaataatgcagaggaaatgatgatcatctccattgaatgacagctgttatatagcaaagataaatgtaaaattagtcttattcttggaagtggaagacagcagttatcagagaggagaatttaatcaaaagaatcagaatagcatggtcacaggccagattcacattgaagtatttactctatattttactgctgttacattcaaaatgtatcagaagtctcatggttcaattaataaaatgttattcgttttcgtaactca

SEQ ID NO: 29128 - DNA, 675 bp, Homo sapiens
cagacataacagataacacatacaaagtgcctaccacatgctaaccactgctgcaggcactttctatagaagaactaatttaatcatcaccataaccctatggggtagatgatatttttacaacctccattttacagatgaagaaactgaagcatagacctgcttatgtgagaagaaacgcagggagacagttcagtcactgcaatcttcatgcccatcagtttcttgtgagaagaaaacaagaaaacaaggactgaaatccacacaggaaggtggcagtgaactccacagacggacctggacgcctcaacactcctggccttacctcccttgctgaacgtctcaagtttctctgcgttcaggactgggcaacgcctgcttcctcctctgagctgtcaagtaggaagtccgggctgctctgctagaaagagaagtcatgtgcaggagcactgaggcatcccaggtgtgacactcttccacctagagcattccgtctctcatcctctgccatgtgacgctgggcttctttaacaaattaatcccaagtgcaagacatttatttcttctgtacctaatgacctgagcaatccttctctgctgaacctggtagtgtcatctttagaagtgaagacacaattaacacatggtcatttcttcattatatcgttgttacta

SEQ ID NO: 29129 - DNA, 414 bp, Homo sapiens
cagacataacagataacacatacaaagtgcctaccacatgctaaccactgctgcaggcactttctatagaagaactaatttaatcatcaccataaccctatggggtagatgatatttttacaacctccattttacagatgaagaaactgaagcatagacctgcttatgtgagaagaaacgcagggagacagttcagtcactgcaatcttcatgcccatcagtttcttgtgagaagaaaacaagactgggcaacgcctgcttcctcctctgagctgtcaagtaggaagtccgggctgctctgctagaaagagaagtcatgtgcaggagcactgaggcatcccaggtgtgacactcttccacctagagcattccgtctctcatcctctgccatgtgtaagtcttctgccttagctg

SEQ ID NO: 29130 - DNA, 807 bp, Homo sapiens
actgtgaggacacagagaagaccactcccacctccccgagtgcaaggtgtgaagggacagatcttttaaccatgcctgcccccttatacttgctgttcatagaattgcaactgaaagtgaccatgaggatccactggatggagttacttctttcttaagtgaggaggctaagacctggagtgacttctccccagatttttgtatacctgactctgtttcagcatccgcttcccaaagaatgcagtgtgaagcaggagcttatgtgagaagaaacgcagggagacagttcagtcactgcaatcttcatgcccatcagtttcttgtgagaagaaaacaagagctccaatctgttagatggtattttgaagcaggtctttgggtaaaggacacctagacccagtgaaggtcatggtgattattattggacaatgggacatcactctgctatttgaacaaataagactttttcctgacatgcatctggaggcaggtcaaagctccaggccaactccaagtttctgatggggtctctagccaatggaaggcttcttctccttcaattgcctgactcttcaggactcttaaatactgcaaagtgagaaaatgagacaggttgcactgagggctgttagccagacagagtctcgaactggaagtccatctagatgttttgcataagagaatggaaacaatctgtctgtgatttagggacatactctggcagcaatatgggaatacagtttcaatcctcattaacaaaacaggtatgaaatacatatttatttagtaaggtgccagctgtatgaa

SEQ ID NO: 29131 - DNA, 369 bp, Homo sapiens
gctttcagaagaatcttatatacatgcaggagtggtgaggctgatggtggaaggagaatgagtctctgatgactttggacttgatgctggaaagacttaagactttgggggactactggaaaggagtgacttctccccagatttttgtatacctgactctgtttcagcatccgcttcccaaagaatgcagtgtgaagcaggagcttatgtgagaagaaacgcagggagacagttcagtcactgcaatcttcatgcccatcagtttcttgtgagaagaaaacaagtggatatacactgttccaagcagcatgtgttgaaaagatttgtcttttccccattaaatggtcttggtacctttctcaaaaattg

SEQ ID NO: 29132 - DNA, 347 bp, Homo sapiens
cctgaagcctttgaagtagaatatggctccctcactcatatttgtatacatatttaggcacaggataaatatggataagcacattaaggctgtttcctgatgtctgagaaaaactccagtcaagattttgcttcctccacaaagcactgaagcacttggctggtggcatgggtagtgtttgcatttttttctgcagaaggatcaggaagggaacacagtggtctgccaccttttgacacttcagggcctcaacccatcctgttttccagagttaggcctgtcccggccaaacgaataccttctgttatgaaaatcatgtgaaaatctgaaaatcttgttctttttcc

SEQ ID NO: 29133 - DNA, 355 bp, Homo sapiens
  misc_feature (16)..(16): n is a, c, g, or t
aggccaaagaaattcnggcacgaagaactggacgcaacctaaacacaaatgagggaggtactggcttctgcctcagggcttctgcacatgctctcttcccttgcactgaacactgccctcaccccctgcccacatcttcacggttcttaagttgttgctctaacgccacctcctctgcgaggcccgcccctaaccactctacttaaaaacagcaccagactgggcatggtggctcatgcctgtaatcccagcactttgggaggccaaggcgggcagatcacttgagattaggagttcgagaccagcctggccaacatgacaaaaccccatctttactaaagatacaaaaaaaaaa

SEQ ID NO: 29134 - DNA, 485 bp, Homo sapiens
ctactcttggtcttgatgcttggggcctccaggatgcctacagtatagaagagactcgttctgaaatccctccaactccttgagccattgatttctcattgaccaagcatgatggaaaaaagcaagcacacatgctcataggcggaagggacttgccttgtcttggatgagacttgagactgtggacttttgagttaatgctgaagacgggacttgctcctctctgccttctgccatgattgtgaggccttcccagccaagtagaactgctatttgcttttgagctactccgggagaggagcagagtcggtttgagttgcatgactgacatcttctggctacagtggatattacagaaagactgaaactccgcaaaagactctagacatgtgacctggagatgcagcatccatcttgtgaccatgaagcaatagggataagggtaaaagtctacacattgcagattgcagataaaaacatgaaaa

SEQ ID NO: 29135 - DNA, 418 bp, Homo sapiens
aactactgacatttaaaatcagtgaataattagtttttatatgaacaaatataacctaaatgcaatggattccttgaaagacccaaactatcaaagctcactcaagaaggaataaacttgaatggctctatattatttaagtttgaagtcattgttaaaaaaacctttacacatacacacacacacacgtgcaccaatgcacacacataattaaacacgacctgcatgttaagatgtcttcactggtgaattctctcaaacattaacggaagaaataataaagccaggaacagtggcatacacctattgtcccagcctcacaggaggctaaggcgggaggactgcttgagcccaagagttttaagtccaacctgggcaagacagcaagactgtgtctctaaaaaaaaatagtaatacg

SEQ ID NO: 29136 - DNA, 413 bp, Homo sapiens
ttttccacatagacgtataagtttattttgtagtaattttccttattcatctcagagaatatgatttatatgtttcggtcttgtggaagtaaaagagaatgatttcctagtggataaaaagaaaccagtctcctttaaggcattctgtctccatgcactccaccatcctcactctggaacccattgcagaggagctcttcaagggggtgttagctttttcctcttttacctcgccttgggcaggctgagacacctcctgctcctcaaataggtgtggcccagtgcttctttacatgtccaaggaggatgtttcagaaggcttgaagagaggaacactcatccaggtgcttaaaatctactggaaggctattctctgaatatgtagaatccaaaacaatctattaaactgtttc

SEQ ID NO: 29137 - DNA, 3185 bp, Homo sapiens
agcggagaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctgagctccaccagccgcctgccccgcctgccccgcctgcctgtcccgccacactggctttaggacctgttgacacggaggggggtttttaatttggtttttaacaactcaggggtttgtttttatttttatttaatttttgcagctcaacttttaaacaaactgcaggggagagggtggggctggaaggaaggctgaggcctggtcagcagtgaccccagcagagcaggccccagtcctcctgggaggctggccccccttttttctgggccctactgccctcctctgcccaggaaatgggggggtttcagcaactcagtgtcacagaataaaatcaagtgtggagtgcca

SEQ ID NO: 29138 - DNA, 3739 bp, Homo sapiens
agcggagaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcagggtcctttagagaacctgatgaaagctatgagtttacacccaagaaattgtctggaaccgttttcaccaacagtgtgccctgaacgcggacccaggccctcaggttgtgtttcataagccttgggagcgctcaggatgcatctgactccccaactctgccctgacccagggcattcttcctggagggggcccccattacagacaggcgagcagaggcttccagaggccgaaggaggggccaggggtcctgctgcagggatggaggcagagctgcgcctcgacatcaggccctgccatccttgtcccctcacggctgggctctgcacaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctgagctccaccagccgcctgccccgcctgccccgcctgcctgtcccgccacactggctttaggacctgttgacacggaggggggtttttaatttggtttttaacaactcaggggtttgtttttatttttatttaatttttgcagctcaacttttaaacaaactgcaggggagagggtggggctggaaggaaggctgaggcctggtcagcagtgaccccagcagagcaggccccagtcctcctgggaggctggccccccttttttctgggccctactgccctcctctgcccaggaaatgggggggtttcagcaactcagtgtcacagaataaaatcaagtgtggagtgccatctggtgtgtagggcgcctctgggaagcctgggcagcagaatgccccttgcacccagggcaagggacccagttcaggcttcacccctcgctgctgagccgatgtcaacacctggaactttcctgtcagttccaacacgattcagagctggctgcctggcagatgattgatactggagtctcattctgcctgattaaaaatggaattagtatgcaacactgagagcg

SEQ ID NO: 29139 - DNA, 2481 bp, Homo sapiens
aacgtaggctagtacgaggcttggtgttaattcggccgagggtgttacgaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctgagctccaccagccgcctgccccgcctgccccgcctgcctgtcccgccacactggctttaggacctgttgacacggaggggggtttttaatttggtttttaacaactcaggggtttgtttttatttttatttaatttttgcagctcaacttttaaacaaactgcaggggagagggtggggctggaaggaaggctgaggcctggtcagcagtgaccccagcagagcaggccccagtcctcctgggaggctggccccccttttttctgggccctactgccctcctctgcccaggaaatgggggggtttcagcaactcagtgtcacagaataaaatcaagtgtggagtgcca

SEQ ID NO: 29140 - DNA, 1493 bp, Homo sapiens
agcggagaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtcattgcctacagattttctccacgtgtccaaatggctttcacctgagctacttgttgaagatctcgtgtgattcagtcaggactgtatttggtcatttaatcagaaaagttagagcagagaatcataaaaagtgaattaaaaaaaaaaactttaaacatataaatacgaatccatcttcctgcctttggataaggggtcaaggccttttctttgagtgtgggtatgttgattggagttctgtgttatctttcttgcttaaaccacacttgtaatgcagcatttatcactttgagttttggtggagtgagaatttagacagtggagaagcagtatgaatatagactctcttcagatttgtacagtttttgctccaatttttttgttgttaccatgcccatacctaatttaaaaataattttaatgtcttttttagtttttccaaagtattcaatttagttatagaaacaattgtttttatattcctatttcaccattttggcagtgagccaagatcacaccactgcacttcagcctgggtgacagagcaaggtctccaagaaaaaaaaaagtgtgcatgtggtattggtattgtgtgtgcgcacacacac

SEQ ID NO: 29141 - DNA, 950 bp, Homo sapiens
agcggagaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggtgagtactagactattgtcttactttttttttaagtacactgattaagtattggaattccctctctgctgcagagtaaataacacaatgccattgatatagtcctaaaaatcttgaaatggggcctgtatttaccttatagcgccccctctaccccctttagagcaaa

SEQ ID NO: 29142 - DNA, 118 bp, Homo sapiens
ctgatctggataaagtggctgccgagagggctacaagcgtctacttggttcaaaaggtaaaaatccatctctagtttcttttttcttgctttgtttatttgtttgtttccctggaaga

SEQ ID NO: 29143 - DNA, 417 bp, Homo sapiens
actagacatggcgcccgataccctgcagaaacaggcggaccactgtaacgaccgccgcatggcgtccaagcgcgtgcaggagctcagtaccagtctcttctttgctgttctggtcaaggtgagccctccagcctggtgcccctcacctccctctggctcccgaccctcctgggcacctgctcaccaggaggcctcgaggagcccagggcagtgccaggaggtgccatggctgcagcactgtccctgcaggagagtggccccctggagtcagaagccatggtgatgggcatcctgaagcaagccttcgacgtgctggtgctgcgctacggcgtgcagaagcgcatctactgcaacgtgagtgccctgggagagcccgggggcgggcagggcagcccaagccatcccgcactggagggg

SEQ ID NO: 29144 - DNA, 682 bp, Homo sapiens
agaaaggaaattaaacattaaaagactttaagtactttactctttatataatgtcactaagaaaaagccaggaaaatcagggttgggtttttaaatttatttatttaataaatataatctattttccaccattttgtttgttatggctggtaccaaagtacttttaaaagttaacatttattatgattttgttttatttcagcagatgtgcataataaattaacctatctctattcttcattttgggctggggcagcatttaacatctagttttttggaatttcgacacacaggctatttagtttaattcaacatagtttgatgctctccagttgtatgatatttatgatagtatgtgaataatgttaagtagataaaatgtggtctgctgaggctgagtgctcagcctgagtataatactggtatgtgacaggtccactggcggcctggggttcttctgtaaagtgagtagtttggggtaactggtatccaggcatctttctagattgaattttaaaatcccactaattgatatgcatctggttgatgactcctcttctctctttatctttttaatgtaggaagagaggatggtgatgcaccggttacaaaagatgagaccacctgcatttcacaagacacaagagctttatcggagaaatccctgcaaagatcagcaaag

SEQ ID NO: 29145 - DNA, 663 bp, Homo sapiens
cctcgcttagtgctccctttggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagggaagcacttatcctagggtctttccttttatattttcctcatgggtggttaccgcccctaatatttcaatttattcttatatctaatctcattttttttaaataaggtcttttaaaagttatcgcctgttattttaatttttgcctttttaaataaaattcaagtcgccttattattgttctatgatcctgttccattttttcttttcataattaatgtccactgggtgcattttatatagggtgtccccgtctctctatttccttatttttggtaatttacctcatttttcttgtgaaaaac

SEQ ID NO: 29146 - DNA, 3411 bp, Homo sapiens
agcggagaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctgagctccaccagccgcctgccccgcctgccccgcctgcctgtcccgccacactggctttaggacctgttgacacggaggggggtttttaatttggtttttaacaactcaggggtttgtttttatttttatttaatttttgcagctcaacttttaaacaaactgcaggggagagggtggggctggaaggaaggctgaggcctggtcagcagtgaccccagcagagcaggccccagtcctcctgggaggctggccccccttttttctgggccctactgccctcctctgcccaggaaatgggggggtttcagcaactcagtgtcacagaataaaatcaagtgtggagtgccatctggtgtgtagggcgcctctgggaagcctgggcagcagaatgccccttgcacccagggcaagggacccagttcaggcttcacccctcgctgctgagccgatgtcaacacctggaactttcctgtcagttccaacacgattcagagctggctgcctggcagatgattgatactggagtctcattctgcctgattaaaaatggaattagtatgcaacactgagagcg

SEQ ID NO: 29147 - DNA, 2528 bp, Homo sapiens
agcggagaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggtgagccctccagcctggtgcccctcacctccctctggctcccgaccctcctgggcacc

SEQ ID NO: 29148 - DNA, 1313 bp, Homo sapiens
acagtacatttagaggtaataagcaccacaagacaggaacaggaaaagtgctctgagatttgagaggagggaaccactatttcccattaggattgtctagagatgctttattggaagtgacatgtttgagccaggccatggattggtgcagtttgagactaggtcagataccatctctgaagcctcttctggtgcccgtcgctgtgacaaggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtcattgcctacagattttctccacgtgtccaaatggctttcacctgagctacttgttgaagatctcgtgtgattcagtcaggactgtatttggtcatttaatcagaaaagttagagcagagaatcataaaaagtgaattaaaaaaaaaaactttaaacatataaatacgaatccatcttcctgcctttggataaggggtcaaggccttttctttgagtgtgggtatgttgattggagttctgtgttatctttcttgcttaaaccacacttgtaatgcagcatttatcactttgagttttggtggagtgagaatttagacagtggagaagcagtatgaatatagactctcttcagatttgtacagtttttgctccaatttttttgttgttaccatgcccatacctaatttaaaaataattttaatgtcttttttagtttttccaaagtattcaatttagttatagaaacaattgtttttatattcctatttcaccattttggcagtgagccaagatcacaccactgcacttcagcctgggtgacagagcaaggtctccaagaaaaaaaaaagtgtgcatgtggtattggtattgtgtgtgcgcacacacac

SEQ ID NO: 29149 - DNA, 936 bp, Homo sapiens
  misc_feature (18)..(18): n is a, c, g, or t
  misc_feature (38)..(38): n is a, c, g, or t
cccgggccttgataccangacttccgtgccagatgatncagaggctcattccagctcgtgccgaattgggcaccagcggcacgagctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtcattgcctacagattttctccacgtgtccaaatggctttcacctgagctacttgttgaagatctcgtgtgattcagtcaggactgtatttggtcatttaatcagaaaagttagagcagagaatcataaaaagtgaattaaaaaaaaaaactttaaacatataaatacgaatccatcttcctgcctttggataaggggtcaaggccttttctttgagtgtgggtatgttgattggagttctgtgttatctttcttgcttaaaccacacttgtaatgcagcatttatcactttgagttttggtggagtgagaatttagacagtggagaagcagtatgaatatagactctcttcagatttgtacagtttttgctccaatttttttgttgttaccatgcccatacctaatttaaaaataattttaatgtcttttttagtttttccaaagtattcaatttagttatagaaacaattgtttttatattcctatttcaccattttggcagtgagccaagatcacaccactgcacttcagcctgggtgacagagcaaggtctccaagaaaaaaaaaagtgtgcatgtggtattggtattgtgtgtgcgcacacacac

SEQ ID NO: 29150 - DNA, 472 bp, Homo sapiens
tcacatatggctttctatggcaataacagtagttcacatccttgttttaaagggctagatagtattgtattgtgtggatcttccataatttaatgacattttctcccgttgatagatgtgtgtttggttgcttccatgtttttccctgctctgtgcaatgctaggatggacatccttgaactccatccttgtgcatttgcttggtcctttctttaagataagttcttaggaaaggagctgctgagtgtgtgcattttcatcattgccgttctgctctctagaggggagaatctttcccatctcacaactctctccctctatggccccacggctctcctttccagcgaggcaggcagctgaaggacttccctcttctctgagcacagggccacctcattctggtcccatgggacaaagcagccatatccaggccacagaaagcaaagccaggagagagaacaacgagcggtgt

SEQ ID NO: 29151 - DNA, 839 bp, Homo sapiens
tctagctatctatgtcattttgtttgtgtgatagcttttcaggaccatggtgactggataaatcaggttctgcgctccgtctccccatttccaggtggcttctgcctgttcagtcctgacactgttataatgccattttatcgtttagacatttgtatgtaaacaaatcttgaccactggaatagtggaagggggttctcttctggggagaaggaggaggcattcaacctgtcagcaagcaaaggagctgggcagggcctggaaagcaggagaccaggttttgggagacccagggcacagggtagccagagcagggacccccaggcctgagtgctcctccagtcccttatgtgagcagggctcacaaggcctgccctcccactgcctctcatactccatggggacaaaaagacatatctaggggtgcttgtttgcaatttctgaatttgaagactgagtaacgaatgtcagagtcctgcgttatgccctcttggggtcttgctgcccaaagtgagatcagaggagcactttgggggcttgttggaaatgcagaatcttaccctcccatactggctgtatctgacaaggttttcagtgattcccgtgcacttgtggagaatcacaggtctaatgtgtaccaacggggaaaaagaagggaaatttacaggggcaggagcgcaggatgctctcctgggactgcagagaagttctgaggacctggctttgcggtcctctcatggattcatgggtttgttctctgggctcaaaattatatcccaggattgggagagcaattttacagtagggacttctgcttctggatcatccttgggtcagaa

SEQ ID NO: 29152 - DNA, 315 bp, Homo sapiens
gccctctttgaatgttacagtcaccaggaagaggggtttaaatctctcaaatgggtcaagtcctgttctaagacctttatgacttgccatacagtatatttgtcaagcaagggtaacgttatgattgtgaagaacaggcactgggggagatgaatgagagatctcttcagcagcaactccattcttgtaaacttggctcacatttttagtgacgtgttcttttagtgtcctagctagtctgttgttcagatcatcatgcagccccagccctgttcaatggtggtatatcattcctttgagctttagcttttacca

SEQ ID NO: 29153 - DNA, 841 bp, Homo sapiens
caagatcttccagggtaagttcatggagaaaaaagagaaaggatgaaaagaaagtgaagaacttcagaaaatttaatagatttcagagacagagtcccaattcaagacgaaaagcaaagtgacaagaaaaaaagttaacagtagtttagaaacgaggttatttgtgcttgaactaggaaagaggcaggtggaaggaaaaggaaattaattatagagaatatttaggaggtatcaataagtcttggtggctgagtgtacagaagataagatagaaggaggaaaataggggaatctcaagttctagtttgggcagatacgtggatagcaacatcacatccattacaatgaaatggttctgttggcaaaatggtggccacagacagctttgaggacataaaggttcttgagttataaaggataaagaaacagttaaatcaagcaggagacaactcagcatgcttccagagatgcaggtttctctggtcctagtagagctgacaatgtaactgggaaaatgggatttgaaggggaattctccttgggcattctcacagtgatctccatggcccctaaccccaccagctgcactgttctagaggctcttatcaccagtcggcctgctccccaggtacaagtaactaatgcataataaatcagcacatttcagagcacagggacaaaggctgaaccaaatgtaaatttctcaggtgtggcatttcttggaaggcttaggcttcaaatctacaatctattttctaacctttcagtgtatttgctctattaaactagcaggtctaatcttcttgtttatctaaagcaatttcttacattttatcaggaa

SEQ ID NO: 29154 - DNA, 381 bp, Homo sapiens
gcacgaaagttccttcccttcaatccctgcgctgggacccggggaccctggcgttcctgattccaacccagggagggcctcgggccagctaggggtatcgcaaagtgggcagaaggccctgaggggaaggttaggtttgagggaggggatgtgaggcacctgtggcaggaaaaaaaaaaatcgcgccgccgagaagcgggcctggtcccccatgcacgaaactgccttcccttcaacccctgctctgggtcccagggaacctggcgcccctgattcgaacccatggagcttctcgggcccgctagggtaccccaatagcggcagaaggcccctgaggtgaaggtaagatttgagggaggggaggtgaagcacctgtgtcag

SEQ ID NO: 29155 - DNA, 523 bp, Homo sapiens
gttggcacgaggagccactttgagttcaggggacatggttttctccagcttcactagtgttgcatctggtacaaggggttaagtgctaaacccctgtaggattgtcacagtgaagccagataacagagtaaccgcaaagagatttaattctgtagtcccacaaaggagggtgtgtaaagagtgtacaacagtgtcagagtttggaaaccaagggttgacaaagttggttctctggaatctgggggtaccagttaaaaggttaaaaggagtcattgttttctgaaactatccaagagttacagccatgtttttttgtttttgtttttgtttttaagatttcgggggaatcttattttctcacatgtttctggaatttttcttttttttttaatttaagttccagggtacatgtgcaggatgtgcaggtttgttacataggtaaatgtgtgctatggtggtgtgctgcacctatcaacccatgaccaaggtattaagctcagcaagcattagctatttttcctaa

SEQ ID NO: 29156 - DNA, 388 bp, Homo sapiens
agagcttctggaggtgggggagatgtaactgagtgttgcagagctagctttagttctcggtgggctaactcaccttactgttggcattaccaaaggcttcccaagtttcatagaccatgcactgcacttatgaccttgtgggaacgtagtatgaacaggatttatatcattggttttcatagaaacagaatagctactcttgtttttgttttagtggctgtactataaggaaaagcatagttaagaaagggccttggtcaactagagcaataacgttttcatgcttcatatggttgttatgccagtttttattagggaatttttttccttttgtttttgatttctttgacctatatggctgtacttttaggaatattgtcatctattg

SEQ ID NO: 29157 - DNA, 359 bp, Homo sapiens
cttatataggattacatatttttattgaacctgagctgcttcaagtaacaatcatttgctctttaatagtcataagtttatacctcttaagttttaatattttccccctacccccaccatcttccaaactaaaaataggtttctgctatctttaaaaggttaataagaaattaaaaagaattggaacaatatgcagacataatcatggcctagaaatggaggtggtcaacaaaatagtttatggcacagattcagagtgagactttgtgggtttgaatgcagattctaccactttctagctgagtgggcctcagcaagctacttactttctctaagcctgtttccttatctgtaaatat

SEQ ID NO: 29158 - DNA, 93 bp, Homo sapiens
gcaagatctgcacaagtcagttttgagtgactaatagaccctctcctcttgatcctgctgcatttcattttcacaacatcttccaatgaagta

SEQ ID NO: 29159 - DNA, 139 bp, Homo sapiens
tacctcatttgacttctcagaagcattaaacacttccttctcttggcctctgggagaccactgtccttgttttcttcctacttcccttggtctcctttgctggctcctcctcctctgattggaaaatacagtattgaac

SEQ ID NO: 29160 - DNA, 477 bp, Homo sapiens
tatggtcatatgcacataaaaagtaatatgtattactcttcccatatacttagtcgttacccctctattttaccatatgctcactactgttgagggcttgcctactcactcctgtggttggagtcaggaccacataagatggtctataatatgagcttgagggatggctaggaaagattctctgatttaaaacacctctgctgagattctgtcttccatgattcaattatttgggttattaagcaaactgcattagcatacaatacagttggaacggttagcatgtaataataataatgcaaactaacatttgtacagctttccaattataaagtactttctcatttttcatgttaatactttagatctagattatttttcactttgtagatgatgcaagagtccagaataattatgtaccttgtccaaattcatgtaaataacacatcttagaaccagccaaacaatgtaggtaaa

SEQ ID NO: 29161 - DNA, 452 bp, Homo sapiens
taatttaaattggtcatttgggttaatcacatagaaggtgacgttccattttgtttttgtatgacttgcattcttcaacatttttcatccacagtgcgataaaataatatcatgttcattctcttctatacctttacatttgtgtttccctatggcctttataaataaaacaaacaatttcaatagcaaatccttgcgtgaagtgagttagtgcatctggctcctcccattttcctgttgcaacccaaggactttgagggtcatcatcatatctacctataggccagcaataattttcatgattgggtaactctagtactatggatatgaaaatgtaatactacatttcttaaaaaattacttctattttagtagatctctatataactaccttctggaataacaatattatgtggattattttttctaattaaaatattaaatctttattt

SEQ ID NO: 29162 - DNA, 202 bp, Homo sapiens
ccacatttggcccatcagccatagtttcccaacctctgctttggaaggcctaactcagttaaacattacaagttcatgcagcacggtgtgatggctcacgcctgtgatcctagcacttttggaggcttatgtgggtggatcgcttgagctgaggagtttgagactgggcaacatggtgaagccgtgtttctacaaaaaatac

SEQ ID NO: 29163 - DNA, 1412 bp, Homo sapiens
ggaaggctcaatgaaaagcagaaagtccaatttggactgacagcaaatcccaaagcaatgattttaccttaaaatccagggctcctaggccagtctgtgaacagctcatttccagaatttttgtttatgagagggcaaaatggagaactctgtctttcaagcttttctttcaacagatgatttgaaacaaaagcagcacactcatgaaggcgtatgtctgctaaatggttgctatcttaatctttagccacagtttatcaaaacatgtaggaatgggttgagaaattaactggtgctaagattatcagcatggacaagttcctggggagggcctggcgacatgatcaaagctaatggtccctctcccaggagcaaagagcctactatttcatgcatgatgatgttgggctctggcactggaaatctttgctcaggtccattctaagtgtcgaaatggtgtaattaatggttagcctgggtatgcactattcaatcaggcaatttttttttttttttttttttttttactaaatccgaacattaatgctttctcattgtgggaaatgagagctgggataaagacatgctcaactcaacagaacaaacacaacctatatgtgactttatgttagtctaggaactgtgcactgatgcacacccaggaggcactaagttaacacacatgcatgcatacctgcctgcctgctgggtaaggagggctgggcaggggaggggggccgccctggctgggggacacggctggggccattgttgccactttctcctctttgtagacatcaatttttacaaagggccgaatgataaaggtccacaagacctcacccagaacggctgttgcaggaagcagaggcctgagcagcctatagccagaagcccaggcagggggtgtgccaactacacaggcccacatgaagagcctccatgaggaagacgttatggcaagaatcctctaagtctccaagggacgagatcagaacaatgtatggaaggtgaagtgatacagatttcagcttaataaaaggaaggcggcccgaaaaatggaactgttcaaaaccacaatggcttcatttaatgggttcgatgtccccagtctgcaggaatgctgtagaagattcaggtagtgagaaatacctcaacagacaagaaagctacttcaaggacttccttcggcaaggcctttcaaacaagttttaacattgaaaacacccatccttcaaagagcttgaagccccaagtgtccatcttccaggatgcacaagactccccaagccttcatcctcccattactatttaatatccacactacattgttcggcacttggtttccctccagtatgcaccgtggcagccagtaagacacccccagggagcacaaccgcagctcactattt

SEQ ID NO: 29164 - DNA, 870 bp, Homo sapiens
  misc_feature (25)..(25): n is a, c, g, or t
tgtggcgttctagaggatccctgcngtgctgggataaagacatgctcaactcaacagaacaaacacaacctatatgtgactttatgttagtctaggaactgtgcactgatgcacacccaggaggcactaagttaacacacatgcatgcatacctgcctgcctgctgggtaaggagggctgggcaggggaggggggccgccctggctgggggacacggctggggccattgttgccactttctcctctttgtagacatcaatttttacaaagggccgaatgataaaggtccacaagacctcacccagaacggctgttgcaggaagcagaggcctgagcagcctatagccagaagcccaggcagggggtgtgccaactacacaggcccacatgaagagcctccatgaggaagacgttatggcaagaatcctctaagtctccaagggacgagatcagaacaatgtatggaaggtgaagtgatacagatttcagcttaataaaaggaaggcggcccgaaaaatggaactgttcaaaaccacaatggcttcatttaatgggttcgatgtccccagtctgcaggaatgctgtagaagattcaggtagtgagaaatacctcaacagacaagaaagctacttcaaggacttccttcggcaaggcctttcaaacaagttttaacattgaaaacacccatccttcaaagagcttgaagccccaagtgtccatcttccaggatgcacaagactccccaagccttcatcctcccattactatttaatatccacactacattgttcggcacttggtttccctccagtatgcaccgtggcagccagtaagacacccccagggagcacaaccgcagctcactattt

SEQ ID NO: 29165 - DNA, 1359 bp, Homo sapiens
ggaaggctcaatgaaaagcagaaagtccaatttggactgacagcaaatcccaaagcaatgattttaccttaaaatccagggctcctaggccagtctgtgaacagctcatttccagaatttttgtttatgagagggcaaaatggagaactctgtctttcaagcttttctttcaacagatgatttgaaacaaaagcagcacactcatgaaggcgtatgtctgctaaatggttgctatcttaatctttagccacagtttatcaaaacatgtaggaatgggttgagaaattaactggtgctaagattatcagcatggacaagttcctggggagggcctggcgacatgatcaaagctaatggtccctctcccaggagcaaagagcctactatttcatgcatgatgatgttgggctctggcactggaaatctttgctcaggtccattctaagtgtcgaaatggtgtaattaatggttagcctgggtatgcactattcaatcaggcaatttttttttttttttttttttttttactaaatccgaacattaatgctttctcattgtgggaaatgagagctgggataaagacatgctcaactcaacagaacaaacacaacctatatgtgactttatgttagtctaggaactgtgcactgatgcacacccaggaggcactaagttaacacacatgcatgcatacctgcctgcctgctgggtaaggagggctgggcaggggaggggggccgccctggctgggggacacggctggggccattgttgccactttctcctctttgtagacatcaatttttacaaagggccgaatgataaaggtccacaagacctcacccagaacggctgttgcaggaagcagaggcctgagcagcctatagccagaagcccaggcagggggtgtgccaactacacaggcccacatgaagagcctccatgaggaagacgttatggcaagaatcctctaagtctccaagggacgagatcagaacaatgtatggaaggtgaagtgatacagatttcagcttaataaaaggaaggcggcccgaaaaatggaactgttcaaaaccacaatggcttcatttaatgggttcgatgtccccagtctgcaggaatgctgtagaagattcaggtagtgagaaatacctcaacagaacattgaaaacacccatccttcaaagagcttgaagccccaagtgtccatcttccaggatgcacaagactccccaagccttcatcctcccattactatttaatatccacactacattgttcggcacttggtttccctccagtatgcaccgtggcagccagtaagacacccccagggagcacaaccgcagctcactattt

SEQ ID NO: 29166 - DNA, 294 bp, Homo sapiens
caacgtggcagcctcagatagcatttcaagagaggtaggcctcggctctggaatttgaataatatcacttctgacaccttctattggtcaaagcaagtcatgaagccagccgtattcatgaggttctggagtaggctttgcctcttgataggaggagctgcaaaacatttgtcaccacatttaatctaccacaggatacaaggcttctcaagatcttgtcccagactgtcacttctccaacctcatttccttgctcaaactctttgcaatagccattctgaactatgtgcactt

SEQ ID NO: 29167 - DNA, 789 bp, Homo sapiens
agagttttcagagtaccctgctgtggccttggaaacagaaaacccacacagaggtcaaacgcagttctcgtggagtcaccttgtcatcctgctttgttttggaaggaactgggtcggaggcagcacagtaggactacagcatctttaacccttgtgcctagcagagttccacatacatgaaataagatgctttgggaaatcattcttctttttgcaacgtcagtgacttgaaccagaaactgatattgactcacttgggctctgactctttccaagttacacatctgggggcctaaggaactgccccatgagttcccggagctgcgatgggcatgggacgggaagctttgtaagcaattaatcacacagttagcctcatctgatcaccactggccacgatcaggccctctgaaagtgcctagttggatgcttgccaatctgctatgccttggaggaaaaaatcatttcaatttaagaaaatagacacagaagcaaaaaaccaaagtgagcctggaaggtttgcctgtctgtgacagtctacagagcagctgtttgtgcctgtcacctgctcaggctctcacggtgactgcatggggagggcagggtgtgtgcattgatacctgccgtgcccagtgtacaccgaggtttgcccatgctgcagctggaaggctgcagaacaaaggttcgttccaacctctacacttgaattgcattctgcgtcatcatcctgccttctagaacaacatccaactccgtgggctgccttttaaaatcttgatggagggggag

SEQ ID NO: 29168 - DNA, 720 bp, Homo sapiens
ccacatcctgcatctccctccagcttcagggaggattccaggagtggcgtggggctagagtggcctgagagacttcagggacaagtgcctagcagagttccacatacatgaaataagatgctttgggaaatcattcttctttttgcaacgtcagtgacttgaaccagaaactgatattgactcacttgggctctgactctttccaagttacacatctgggggcctaaggaactgccccatgagttcccggagctgcgatgggcatgggacgggaagctttgtaagcaattaatcacacagttagcctcatctgatcaccactggccacgatcaggccctctgaaagtgcctagttggatgcttgccaatctgctatgccttggaggaaaaaatcatttcaatttaagaaaatagacacagaagcaaaaaaccaaagtgagcctggaaggtttgcctgtctgtgacagtctacagagcagctgtttgtgcctgtcacctgctcaggctctcacggtgactgcatggggagggcagggtgtgtgcattgatacctgccgtgcccagtgtacaccgaggtttgcccatgctgcagctggaaggctgcagaacaaaggttcgttccaacctctacacttgaattgcattctgcgtcatcatcctgccttctagaacaacatccaactccgtgggctgccttttaaaatcttgatggagggggag

SEQ ID NO: 29169 - DNA, 847 bp, Homo sapiens
cccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaagggtgagccggcgcggggccctaggccggccctgcctccccaggcacactcaacactgccgctcccgcagcacagaaacacagccatcaactccagcacacgcctgggctcagggggaacacaggacgatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccaggtaaggcttgggtgttcctggggtgcaagggcaggccaggtaagtcttgcctgcaccctaagggccccatgactacatttactaggctcacgccctgcagtcagccaactgctctgcccctagctccaggggcctgtctcctg

SEQ ID NO: 29170 - DNA, 1498 bp, Homo sapiens
cccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaaggatctccattacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 29171 - DNA, 1759 bp, Homo sapiens
cccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaagggtgagccggcgcggggccctaggccggccctgcctccccaggcacactcaacactgccgctcccgcagcacagaaacacagccatcaactccagcacacgcctgggctcagggggaacacaggacgggtcagacacacctctgttaaaaactttatagaggggcccgggcgcggcggctcacgcctgtaattccagcactttgggaggccgagacgggcggatcacgaggtcaggagatcgagaccatcctggctaacacgatctccattacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 29172 - DNA, 937 bp, Homo sapiens
gcggccgcctactactactaaattgtcggccgctcgacgggacaggccccagtcccagagacccccacctggtgcccagagcacctgctcagtgggagaggggaaccaggccctcttccccacattggcctgggcgctgcctggggaggtatgctgggtgggtggttagacgcacctgggcaggtcacctctggctgctgcaatgactgtttcagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 29173 - DNA, 1481 bp, Homo sapiens
cccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaagggtgagccggcgcggggccctaggccggccctgcctccccaggcacactcaacactgccgctcccgcagcacagaaacacagccatcaactccagcacacgcctgggctcagggggaacacaggacgggtcagacacacctctgttaaaaactttatagaggggcccgggcgcggcggctcacgcctgtaattccagcactttgggaggccgagacgggcggatcacgaggtcaggagatcgagaccatcctggctaacacgatctccattacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggtgagcaggctggcgtccatgtgctcacaggggtgagtgccccacggggaccccagcctgggtggcctctaggggtgctgaccaggcgccctctgctgggccaagctccaggatttggggatgaaggtgcagctgaaaagagccctgcaagctgaagccaccgggaggggattaagggggggtgggcaggaccagggaccagtcacagggcagtaaggcctcacagcaggcaccccagggcggggcagcaagcaggcaggaggggcctccccgggtggccttctagggaggatgtaccctggctgcccagcagcagccctgcttggccgtgtccctgccacaagcaggcaggacacaggagggatggcactgcccacggagccctgggctcatggcaccttctgcagagtgagccgggagcagagagcctcttttccccactctgtgaggccgggcattttcctcagccctgccctaacccccaccattcctgtgatgggcccaggtgctagacgggccttgtccttgccgaggaaacccatgcaggctgggtcccaagcctctcatgcagtttcattttacc

SEQ ID NO: 29174 - DNA, 1300 bp, Homo sapiens
cccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaaggatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 29175 - DNA, 1905 bp, Homo sapiens
cccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaagggtgagccggcgcggggccctaggccggccctgcctccccaggcacactcaacactgccgctcccgcagcacagaaacacagccatcaactccagcacacgcctgggctcagggggaacacaggacggtaagcccgccctgccacgctgagctgtcccctcctcccagagggagacccgcgtggcccccgggcagtgccgaccctgtctgcctgtctcgtagggcagcagcatttcagatgctgactccgccaatcctctcctctccaagcagggtcagacacacctctgttaaaaactttatagaggggcccgggcgcggcggctcacgcctgtaattccagcactttgggaggccgagacgggcggatcacgaggtcaggagatcgagaccatcctggctaacacgatctccattacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 29176 - DNA, 1179 bp, Homo sapiens
cccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaaaagcctgcagttcctgcagcagcagcactcggagatgctggccaagctccatgaggagatcgagcatctgaagcgggaaaacaaggatctccattacaagctcataatgaatcagacatcacagaagaaagacagcctctccatgtcaagcttccagtctgtcaagtccatctctaattcaggcaaggccaggccccagcccggctccttcaacaagcaagattcaaaagctgacgtctcccagaaggcggacctggaagaggagcccctacttcacaacagcaagctggacaaagttcctggggtacaagggcaggccagcccaccacacttaggcagtgcgaagtgctcatccgcgagctgtggaataccaacctcctgcagacccaagagctgcggcacctcaagtccctcctggaagggagccagaggccccaggcagccccggaggaagctagctttcccagggaccaagaagccacgcatttccccaaggtctccaccaagagcctctccaagaaatgcctgagcccacctgtggcggagcgtgccatcctgcccgcactgaagcagaccccgaagaacaactttgccgagaggcagaagaggctgcaggcaatgcagaaacggcgcctgcatcgctcagtgctttgagccaccccaatctggtcagtgccaggcccaccaacctgcagctggagactggctctctatagcatttcctgatacttccgctacttttaggcctggctaaattccaagacagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaa

SEQ ID NO: 29177 - DNA, 722 bp, Homo sapiens
tggggaggtatgctgggtgggtggttagacgcacctgggcaggtcacctctggctgctgcaatgactgtttcagaaaggagaaagcagaggcctctaatgcaggagctgcctgtatggggaacagccagcaccagggcaggcagatgggggcgggggcacaccccccaatgatcctgccccttcccctgcgaaagcccaccacacttaggcagtgcgaagtgctcatccgcgagctgtggaataccaacctcctgcagacccaagaggtgaggccctgggtggtgggggtggccctgggcagtctggcaccgccacaggccccaccatgcccctgcccctgcctttcagctgcggcacctcaagtccctcctggaagggagccagaggccccaggcagccccggaggaagctagctttcccaggtgagtgcctggtgcacccctgccccatccctggggtcctatccacagctcactgctgactcttccttcacccagggaccaagaagccacgcatttccccaaggtctccaccaagagcctctccaagaaatggtaagtcccacaggcatggggacagtggggcagccctgcagcctgggccccagggagggagtggggaagggagggtggcagcgcagaagcagagctcgctgaggcctctctgtgcccccgtgagggccatgcaggccgcactccccacacactccactcccggggat

SEQ ID NO: 29178 - DNA, 1873 bp, Homo sapiens
atgacaggaagtgacccgttaaggaagcagcacatcgctgcattcggctggttttcagggtcttgttcccaatcagtttccagccaacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccac

SEQ ID NO: 29179 - DNA, 1829 bp, Homo sapiens
ttctgcactcacagccgaagggaaagcagcaggttggggcttcttgtggccaacttcagagcctgtcaccaggaaaggtaagcatgggaggaaggaagatggcgacagatgaagaaaatgtctatggtttagaagagaacgctcagtcccggcaggagtccacgcggaggctcatccttgttgggagaacaggggccgggaagagcgccactgggaacagcatcctgggccagagacggttcttctccaggctgggggccacgtctgtgaccagggcctgcaccacgggcagccgcaggtgggacaagtgccacgtggaagtcgtggacactccggacattttcagctcccaagtgtccaagacagatcctggctgtgaggagagaggtcactgctacctgctctcggcccccggaccccacgcgctgctcctggtgacccagttgggtcggttcaccgcccaggaccagcaggcggtgaggcaggtgagggacatgttcggggaggacgtcctaaaatggatggtcatcgtcttcaccaggaaggaggacctggccgggggctccctgcacgattacgtgagcaacacagagaaccgggccttgcgcgagctggtggccgagtgcgggggccgggtctgtgcctttgataaccgggccaccggccgggagcaggaagcccaggtggagcagctgctggggatggtcgagggcttggtgctggagcacaagggcgcccattactccaacgaggtgtatgagctggcgcaggtgctgcgctgggcaggccctgaggagcggctccggcgggtggcggagcgcgtggcagccaggtgcagaggaggccatggggcgcctggctgtcggcccggctgtggaagtggctgaagtcccccaggagctggaggctgggcctggccctgctgctggggggcgcgctcctgttctgggtgctgctccacaggcggtggtcggaggccgttgcggaggtcgggcctgactgacagcgcaggtcctaaaactgaaggcaacttggttaagggaggctgaattcttggagctgaagggaaaacttcattccaacggaaggaatcctgtagtttcaggcatagttttaatgacacagaaaactttgctgcatcacctttgcaactttgccaaagctcagagttcactttttaagtttttaactcattttaaatgatgtgtatgcagagttttaaaataaattcgtctaacaataacttcctttggtagttttggtagtctaatgtcaagtagcttgtagtggggacaaacgcatggcacagggaaaacaagtgccattattttcgagctttttaaaaaatttagactgcccctccttgataattttctagttcttatacatgggtagataggttcctttgtgatccttgtagacttttagcatcaataaaagaaatgtgggggttacacacgtgaatgttacttctgagacatcagtttatagtacaatgatttactaccaaaaagatgaatgtaactgtactgttacaaagtggaaaataacagtttccacttttctagaacatattatggttcatggcattccaaaatgaagtaagggccgggcgaggtggctcacgcctgtaatcccaacactttgggaggtcgaggcaggtggatcacctgaggtcaggagttcgagaccagcctgaccaacatggcgaaaccccatctctactaaaaatacaaaaattagccaggcgtgatagcactcgcctgtaatcccagccattcaggaggctgaggcgggagaatcacttgatgcagtgagccgagatcgtg

SEQ ID NO: 29180 - DNA, 1810 bp, Homo sapiens
atgacaggaagtgacccgttaaggaagcagcacatcgctgcattcggctggttttcagggtcttgttcccaatcagtttccagccaacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagcta

SEQ ID NO: 29181 - DNA, 2092 bp, Homo sapiens
ttctgcactcacagccgaagggaaagcagcaggttggggcttcttgtggccaacttcagagcctgtcaccaggaaaggtaagcatgggaggaaggaagatggcgacagatgaagaaaatgtctatgacggttcttctccaggctgggggccacgtctgtgaccagggcctgcaccacgggcagccgcaggtgggacaagtgccacgtggaagtcgtggacactccggacattttcagctcccaagtgtccaagacagatcctggctgtgaggagagaggtcactgctacctgctctcggcccccggaccccacgcgctgctcctggtgacccagttgggtcggttcaccgcccaggaccagcaggcggtgaggcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccac

SEQ ID NO: 29182 - DNA, 1709 bp, Homo sapiens
atgacaggaagtgacccgttaaggaagcagcacatcgctgcattcggctggttttcagggtcttgttcccaatcagtttccagccaacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctctgtgctgctctcgagcactgccttcaatctcaggttggcagcgtcga

SEQ ID NO: 29183 - DNA, 1744 bp, Homo sapiens
accgtcagggtgggaaagcggtcataccggtccccctataccatttcctctcacgtcagttcttcgtgtccctgatccccacttccatcctcccactggacagtaccttgtaatttcctctccgccgctggaatgtccatttgacacaaagactttctgggactggaagtttccactacttcaaataaaccaatcttatttacagcaaggcaatttttttttctctattctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccac

SEQ ID NO: 29184 - DNA, 1392 bp, Homo sapiens
atgacaggaagtgacccgttaaggaagcagcacatcgctgcattcggctggttttcagggtcttgttcccaatcagtttccagccaacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcaccctgagccaccagccctgcagcctgccctatctccgcatttccagttgtattagccaatagatttcctacttatttaagctatttgagctccgggtctcttctacctgcattctaaaacattcaaagtaataaaaatttctccacattcctttttatcctttaaatctgttggaacttcccagtccacatgcttcctttgagcaagtggcatctagaataaaggaacagggttggcttttcttgttcctaaaattaggaagaacctcctgctcctactgaagtgcctgccacatagtggacattccctgaactctgagtaaagcaaaacactttcagatggatggattgcattgacgaatgggagtgggagagggtcaaggaaatggggtgccctgtacgcagggctttctctgtgctttcttctcagtttggccaggggcccaaaagaaacacagctcacatttcaatgctctgcaaggaatcactttggcaaatgttcacacatgagaaaggttaagcaaactctttctccttctccactgtaaaatgtccttggatcaactctccagctc

SEQ ID NO: 29185 - DNA, 2301 bp, Homo sapiens
atgacaggaagtgacccgttaaggaagcagcacatcgctgcattcggctggttttcagggtcttgttcccaatcagtttccagccaacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccacattcctttttatcctttaaatctgttggaacttcccagtccacatgcttcctttgagcaagtggcatctagaataaaggaacagggttggcttttcttgttcctaaaattaggaagaacctcctgctcctactgaagtgcctgccacatagtggacattccctgaactctgagtaaagcaaaacactttcagatggatggattgcattgacgaatgggagtgggagagggtcaaggaaatggggtgccctgtacgcagggctttctctgtgctttcttctcagtttggccaggggcccaaaagaaacacagctcacatttcaatgctctgcaaggaatcactttggcaaatgttcacacatgagaaaggttaagcaaactctttctccttctccactgtaaaatgtccttggatcaactctccagctc

SEQ ID NO: 29186 - DNA, 807 bp, Homo sapiens
ttctgcactcacagccgaagggaaagcagcaggttggggcttcttgtggccaacttcagagcctgtcaccaggaaaggtaagcatgggaggaaggaagatggcgacagatgaagaaaatgtctatggtttagaagagaacgctcagtcccggcaggagtccacgcggaggctcatccttgttgggagaacaggggccgggaagagcgccactgggaacagcatcctgggccagagacggttcttctccaggctgggggccacgtctgtgaccagggcctgcaccacgggcagccgcaggtgggacaagtgccacgtggaagtcgtggacactccggacattttcagctcccaagtgtccaagacagatcctggctgtgaggagagaggtcactgctacctgctctcggcccccggaccccacgcgctgctcctggtgacccagttgggtcggttcaccgcccaggaccagcaggcggtgaggcaggtgagggacatgttcggggaggacgtcctaaaatggatggtcatcgtcttcaccaggaaggaggacctggccgggggctccctgcacgattacgtgagcaacacagagaaccgggttcctagagcagcgtagacagctggtaaactgaagagcacaacttatattcttatgaaaggaatttgtacctttggggtataatcttgtggcgcgtgacctcgttattgttacagctgagtgtaatggtagtcctgtggagaatgtatctggcattatggtactatattattaggtatatttgtatttaacatggtgctaatatatg

SEQ ID NO: 29187 - DNA, 2131 bp, Homo sapiens
ttctgcactcacagccgaagggaaagcagcaggttggggcttcttgtggccaacttcagagcctgtcaccaggaaaggtaagcatgggaggaaggaagatggcgacagatgaagaaaatgtctatgcgggaagagcgccactgggaacagcatcctgggccagagacggttcttctccaggctgggggccacgtctgtgaccagggcctgcaccacgggcagccgcaggtgggacaagtgccacgtggaagtcgtggacactccggacattttcagctcccaagtgtccaagacagatcctggctgtgaggagagaggtcactgctacctgctctcggcccccggaccccacgcgctgctcctggtgacccagttgggtcggttcaccgcccaggaccagcaggcggtgaggcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccac

SEQ ID NO: 29188 - DNA, 1819 bp, Homo sapiens
atgacaggaagtgacccgttaaggaagcagcacatcgctgcattcggctggttttcagggtcttgttcccaatcagtttccagccaacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgtttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccac

SEQ ID NO: 29189 - DNA, 2571 bp, Homo sapiens
ttctgcactcacagccgaagggaaagcagcaggttggggcttcttgtggccaacttcagagcctgtcaccaggaaaggtaagcatgggaggaaggaagatggcgacagatgaagaaaatgtctatgacggttcttctccaggctgggggccacgtctgtgaccagggcctgcaccacgggcagccgcaggtgggacaagtgccacgtggaagtcgtggacactccggacattttcagctcccaagtgtccaagacagatcctggctgtgaggagagaggtcactgctacctgctctcggcccccggaccccacgcgctgctcctggtgacccagttgggtcggttcaccgcccaggaccagcaggcggtgaggcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggtaaggagaactgggtttatgctcacagagactttgggaattgaaaggatcacagtttggtcacagctgttcatttctgacatgaccttgcacagatcccctcacttctgggttcgctggtcagtaaaacggggcaatggtgatgagtgttgcgggcatcagcaggtgcacagctggtggagcacagcctgaagaatctgtgcctgcactcacagcccagtcccaggacagcgggctttgctgccccattgcccattacttagccaagtcgatctccatgaaactctcagggagtaaggctgaactgatcctctcatcagtgggacagatgggagaactgaagctcccagagggtgataggctttcccccatctcccctagcatgccggggcattcttctcaattttaccctcctaatttctcctgtcccagaccagccagacacgtaccatgtctcagacaagcctgggagctgaggatggattcttagggctccccagggcaaatgtgggatattttcccaccccaggagcctcatgttccaaacaagacccctgagtggaccttgtcttgtgactttcaacttctgaaaactaccccatgctcccccagatgccccacatttttcctatgacaccctgccggacgcacaccaaaccgcaaaacacatgattccaatacctggaaatacatgggctggggcagatgggtgaaggagatacttatgaacaaggaagacaagaagtggtttgatcttttctaaaatagtatggaagaggctgctttcttgtaatttgctaaaataagctcttctcatggtaaaatcaggttcatgcaattttcaaatcggaatgtgcattttgttcatttgcttcacccttttccctgagccagaccctcccaccagcttgccagaggctgctactgtcttgcttgcacactgccttccaatctctcatgaactttggtctcttttgtgggacgattagtaaaatttttcctttggagaagacgcctgtcttcattctcaattcctccacttttgtctgccctgtagaccaacacgtatcacattccttcaagcctacggtgtgtccaccacgctctattcagttcttttataatcttctccatgactcattttagcattgccatcagtatcctttctgactcacctgtgaacactttgttatttgtgaatatctgccaaaaaatgtattcctcaatgcagcctgatccactcagaaagcttggattgggagagctattgttgctggtcattggctaacataacatagtttgactggcttttgtgacaggcaattggctgttttaaaagaaaagacctcaattcagagaaactcctgccaccagcaattttatttttgaataaccttttataagaaatgcactcaagattttgcaataaaattctgtgtgttggttttagggtaggcttctagctgtccaattaatttgtctcctgaccagggagtggcagcattgtacacatgttccaagaggtttgttgacttttttggaaaagtctctttttccacctgtggaatcaaggacaatacacagcaaaaggagccatttcctgatgctagctccattgtaaatatgtgacctttggcaggtcatttaatgctcagtttccttgcattttaatagaaattttaagatcagttttgatcacatcacagggaatttgagagagcaattaaaataagaaggatgaaataactttgaaaattataaatgtattcacagaggcttattacaattatgatgttcataatcaatatcattaccactgtcatcttgacccttaccacatcattatgttgattccaaacctcagaaaacgtcatctaaagtagagaggatgtcagggaactggtgctattttagcaaaagccagaagcataatttaccagagacgagaacagggtgtgggagagaggaaaatgttcttctctgggcttaag

SEQ ID NO: 29190 - DNA, 1036 bp, Homo sapiens
atgacaggaagtgacccgttaaggaagcagcacatcgctgcattcggctggttttcagggtcttgttcccaatcagtttccagccaacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagcta

SEQ ID NO: 29191 - DNA, 1425 bp, Homo sapiens
ttcctttgtcttcttgtcacaaaaagaatttcgtcagtctggaaggggagttttacttacgtaaatggatgtagaccagactcaagcatgtaagaactgtgttaatgtggatttctaagcctctgaatgaatttctaaggcacctaacctattgtttctgaaaatatttactttaaggttacaatcttaatctaaaagtggttcctgcttcataatgcctgtggacatgaagctaacaaatcttttcaaaatgtgttcatgtggtaattcactgcagcacaggagcaataatcagctatgtgcaggcatctatgctactgtctcttaaaatactttaaaagtaaggttagttattgtctattcgagtcagttagctcttacaattcatttgatagtgattatcagtacaatatattagtttgttggagtgtgagaataatggtgttaatccttagaaaaatgcaagaccaaagggaaatttaaattttgcatatttatgtttaatgtcaaatttatattcaaataaacggttatgattataactctttgtaaaagaaactccattttaagccccccagattatgatcactttcaaatacaggctcagaagtacagatttagagaaaaaggattcctcttagaggaatacatcatatatactgagacttctagcgagggaaggagtgtagttctggttcaactaagataaagtactgatgaaaggtcactggcagacaatacggagaaacagcctgccttgcaggattttttgtatgcctagtcagcctacccaaggacaatgtgtccagaatgacctctttactgcctgccagctaatcagttatcccataagaaatatgcaaacaagattcacacagcagagagcaattatttttctctccctctttcctctttgtcttaataaacgctctttttttatttgtggggtgaaatcaatctattgaggtatcgtctttgtaaacacataaacagcgtgctataattgactttgtgactttgaattattgacactgctctgtttcttttccaaagaacctttgcactgttgaaagagtaacttttccattataacctgagtcaagatgaagagaagcagggaatactgaatgaaagttacttttccatgcagcaggaaaaaacaagtttgctactatacaaatttatagaaaagtataaaattacatgtgaacttctttttctttttgtgtgtgccaaagttttttaaagatttatatctctactactcaaagcattcccatctctagcctgtattagttctgtcacctgaatcatttttcactcataaccacctggccattctttaacactcagttcatgtagattgtactaggcagtttaaatacattagattttataaacaaagacccagtgagcacagagcag

SEQ ID NO: 29192 - DNA, 393 bp, Homo sapiens
ttcctttgtcttcttgtcacaaaaagaatttcgtcagtctggaaggggagttttacttacgtaaatggatgtagaccagactcaagcatgtaagaactgtgttaatgtggatttctaagcctctgaatgaatttctaaggcacctaacctattgtttctgaaaatatttactttaaggaccctgtgaggtgatattatgacctccccttccctatgcctcagaagaaattgaggcaatgagaaataaagtggtttatccaagatcacacagcaagtggtagagccacaatctgaacgagggctgccctgaagggcagacaggtttattgggcaacagctgggaaaatcagcggttggacttggccacatgctccaagaaggccacacgtcctt

SEQ ID NO: 29193 - DNA, 654 bp, Homo sapiens
tgggaggcccttccgcaatcggagccctcacagaggccaaactgatataaatctgcttaggaggcctgattcacagacgctacaggatggagcggggcgcaggagccaagctgctgccgctgctgctgcttctgcgggcgactggtttcacatgtgcacaggcagatggccggaacggctacacggcggtcatcgaagtgaccagcgggggtccctggggcgactgggcctggcctgagatgtgtcccgatggattcttcgccagcgggttctcgctcaagctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagtt

SEQ ID NO: 29194 - DNA, 534 bp, Homo sapiens
tgggaggcccttccgcaatcggagccctcacagaggccaaactgatataaatctgcttaggaggcctgattcacagacgctacaggatggagcggggcgcaggagccaagctgctgccgctgctgctgcttctgcgggcgactggtttcacatgtgcacagctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagtt

SEQ ID NO: 29195 - DNA, 875 bp, Homo sapiens
tgggaggcccttccgcaatcggagccctcacagaggccaaactgatataaatctgcttaggaggcctgattcacagacgctacaggatggagcggggcgcaggagccaagctgctgccgctgctgctgcttctgcgggcgactggtttcacatgtgcacaggcagatggccggaacggctacacggcggtcatcgaagtgaccagcgggggtccctggggcgactgggcctggcctgagatgtgtcccgatggattcttcgccagcgggttctcgctcaaggttggggctcaggcgtaggtcctggagagggcggagatgcgtgggaccatagagccaaggatgataattccgtgactcgcccttgcccctctcctcgatacccaggtggagcctccccaaggcattcctggcgacgacactgcactgaatgggatcaggctgcactgcgcgcgcgggaacgtcctaggcaatacgcacgtggtagagtcccagtctggaagctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagtt

SEQ ID NO: 29196 - DNA, 770 bp, Homo sapiens
tgggaggcccttccgcaatcggagccctcacagaggccaaactgatataaatctgcttaggaggcctgattcacagacgctacaggatggagcggggcgcaggagccaagctgctgccgctgctgctgcttctgcgggcgactggtttcacatgtgcacaggcagatggccggaacggctacacggcggtcatcgaagtgaccagcgggggtccctggggcgactgggcctggcctgagatgtgtcccgatggattcttcgccagcgggttctcgctcaaggtggagcctccccaaggcattcctggcgacgacactgcactgaatgggatcaggctgcactgcgcgcgcgggaacgtcctaggcaatacgcacgtggtagagtcccagtctggaagctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagtt

SEQ ID NO: 29197 - DNA, 443 bp, Homo sapiens
gcttggaaagtctcaagggcttggtgaatggggggcccgcagaggcaacgcatctccctttgccttgcagctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagtt

SEQ ID NO: 29198 - DNA, 750 bp, Homo sapiens
tgggaggcccttccgcaatcggagccctcacagaggccaaactgatataaatctgcttaggaggcctgattcacagacgctacaggatggagcggggcgcaggagccaagctgctgccgctgctgctgcttctgcgggcgactggtttcacatgtgcacaggcagatggccggaacggctacacggcggtcatcgaagtgaccagcgggggtccctggggcgactgggcctggcctgagatgtgtcccgatggattcttcgccagcgggttctcgctcaaggtggagcctccccaaggcattcctggcgacgacactgcactgaatgggatcaggctgcactgcgcgcgcgggaacgtcctaggcaatacgcacgtgctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagtt

SEQ ID NO: 29199 - DNA, 299 bp, Homo sapiens
gcagtgaccgagatcatgccacgaactccagcctgggctgcctagcgagactatctcaaaaaaaaaaaaaaaaaaaaaaaaaaaaaaggaagtaagggaaaagagttagagttgagaaaccttttgagctaaagggagaaaagtaacaagtttggagttggagcagaggggcattgacagctattggtctcctttcgtggtggagtaggaagctaggtcatcttacagtaagggaagtagaatgggatgctctgcaaaatttatgtggtaaatgtttgaaccagatgctggggcaagag

SEQ ID NO: 29200 - DNA, 939 bp, Homo sapiens
atggacggggtgaatgatagctccttgcagggctttgttctgatgagcatatcggaccatccccagctggagatgatcttttttatagccatcctcttctcctatttgctgaccctacttgggaactcaaccatcatcttgctttcccgcctggaggcccggctccatacacccatgtacttcttcctcagcaacctctcctccttggaccttgctttcgctactagttcagtcccccaaatgctgatcaatttatggggaccaggcaagaccatcagctatggtggctgcataacccagctctatgtcttcctttggctgggggccaccgagtgcatcctgctggtggtgatggcatttgaccgctacgtggcagtgtgccggcccctccgctacaccgccatcatgaacccccagctctgctggctgctggctgtgattgcctggctgggtggcttgggcaactctgtgatccagtcaacattcactctgcagctcccattgtgtgggcaccggagggtggagggattcctctgcgaggtgcctgccatgatcaaactggcctgtggcgacacgagtctcaaccaggctgtgctcaatggtgtctgcaccttcttcactgcagtcccactaagcatcatcgtgatctcctactgcctcattgctcaggcagtgctgaaaatccactctgcagaggggaggcgaaaggcgttcaatacgtgcctctcccatctgctggtggtgttcctcttctatggctcagccagctatgggtatctgcttccggccaagaacagcaaacaggaccagggcaagttcatttccctgttctactcgttggtcacacccatggtgaatcccctcatctacacgctgcggaacatggaagtgaagggcgcactgaggaggttgctggggaaaggaagagaagttggctga

SEQ ID NO: 29201 - DNA, 295 bp, Homo sapiens
tcattagctttgagcatcaggaacatgacagagagaggacagaaacccggtgcagccgaggacagccagctgagcccttgctgagccagcgagatgcagcgtggtgccaccacatctggtctccaggagtcccaggagctcagacgtccgtcgtcttgtgacttcatgctcccctctgccgcgctcacgtgctgggcctgggcagaaaggcaacccaggaaatccattaaagcaagccaagacgacctttgcagcgtaacccaacgattccctaataaatcatgtttccaaggca

SEQ ID NO: 29202 - DNA, 245 bp, Homo sapiens
ttttgtagttaaggaaactgagctcgtaggcatttttgggacttcctggaagaaaattttacaatgccatgaatttggcagggcatatccttatctatcaattttcagacttaatatggtttggatgtgtgtctactccaaatctcaggcagaaatgtgaccctagtgttggaggtggggcctcgtgggaggcactggaacacgggagcagatcccttatgaatggcttggtgccatccccctgg

SEQ ID NO: 29203 - DNA, 450 bp, Homo sapiens
atacagcaaactctgaaagatggacagagagacaggagatggtcctttataatgcagtgtgatctgtgctgcaatagagatggaagagtgttctgatcggctggaaaacaacgcacatgggaagctgtacagaaatgagtggggaaagttttggaagctagaagttcaaaacgaggtgttggcagcaccatgctctctctgaagatgctaggaagaatctgctccatgcctttccattcgcttctggggtttcctgcaagccctgacattccttggcttgtagatgcatcaccccagtttccgcccccatcatcacatggcctcctctctgtgtgtgcctctgcgttccctctattcttcttctaaggacaccgacaccagtcatagtggattaagtgtccactcctaaccaattacatctgcaacaaccctatttccaaataaagtcac

SEQ ID NO: 29204 - DNA, 381 bp, Homo sapiens
atacagcaaactctgaaagatggacagagagacaggagatggtcctttataatgcagtgtgatctgtgctgcaatagagttttggaagctagaagttcaaaacgaggtgttggcagcaccatgctctctctgaagatgctaggaagaatctgctccatgcctttccattcgcttctggggtttcctgcaagccctgacattccttggcttgtagatgcatcaccccagtttccgcccccatcatcacatggcctcctctctgtgtgtgcctctgcgttccctctattcttcttctaaggacaccgacaccagtcatagtggattaagtgtccactcctaaccaattacatctgcaacaaccctatttccaaataaagtcac

SEQ ID NO: 29205 - DNA, 383 bp, Homo sapiens
tattctgtttctaggtctgctgtcacaaaataccagaaactgggtgtcttgttaaaacaacagaaattttttctctcacagttttggaagctagaagttcaaaacgaggtgttggcagcaccatgctctctctgaagatgctaggaagaatctgctccatgcctttccattcgcttctggggtttcctgcaagccctgacattccttggcttgtagatgcatcaccccagtttccgcccccatcatcacatggcctcctctctgtgtgtgcctctgcgttccctctattcttcttctaaggacaccgacaccagtcatagtggattaagtgtccactcctaaccaattacatctgcaacaaccctatttccaaataaagtcac

SEQ ID NO: 29206 - DNA, 341 bp, Homo sapiens
gaaggattccttgtggggtcaggcttctcaaactctgctgactttgcctcttccttttcctcttcctcatcaggtatcagagagtatttggtcccacctggttgcatgaaacaatcttttgcaaagtggcctttacagccacacttcttgcaggtagtgttcaatcaatatactctggttagcatgtaagtgtggggggatgggcaatgggtagagccttctctgtgctgtgtacatagcacagtgcctacacattctgtgccataagtatgttgaaaaactctcattactgaggtaggggtttaatgtccttactggagactatatttagctcttgaaag

SEQ ID NO: 29207 - DNA, 448 bp, Homo sapiens
cactttcagtgaaccttcggagggcgaaggggaagctttccttctttgaccctacacctgaatatctcccatgtgtacatacatgaggtatacatgttattaaactttgtttttctctcattttgttacagcagtccattccaaccaagagctcagaaaggggagagaaaaaattaattttttcctccttacactagtgatggtgcacagagtccatctggcaaggataaaggcagagacattctgttcattaaagcagcagtgatagggccagctctggtggctgtcccaagcagggggcaatgatgacttcactgagcagctctgcagcacaggttggggcactgttcctgtctgctagcctctaatcttttgtctctgggcctcccttggagcccttcagctgtttaattctttttgaaataaactcattttactgctgaaatga

SEQ ID NO: 29208 - DNA, 460 bp, Homo sapiens
tgcacgaaatcattcttttattcctgatcctgtttcctgtttatttcatgaacttgtctgtaggcagcatggtgctgggcgctgcaggggctcattaatgcatgagacacagattccactcaggagagagaagacgaacacagacacagtacacggtgggaaggggcacttccatgtctgcagccagagagccctttcagaatctgacccaaaagatggccagtattctaagaaaaagcacatatgcttacgatgtgcaaacagctgaaggtgttctttcaactatagtaaaaggggtgtctcggtggccacaggcggcccagatgaaggtgctgctggggaaaatgtcaccacgctggtcttgggaggctccatgagagggaggtgggacttgagaggggcttagagcctgggtgagaggcaaagaggaggccagagaccttctgggtagagaggaccc

SEQ ID NO: 29209 - DNA, 3049 bp, Homo sapiens
tgcacgaaatcattcttttattcctgatcctgtttcctgtttatttcatgaacttgtctgtaggcagcatggtgctgggcgctgcaggggctcattaatgcatgagacacagattccactcaggagagagaagacgaacacagacacagtacacggtgggaaggggcacttccatgtctgcagccagagagccctttcagaatctgacccaaaagatggccagtattctaagaaaaagcacatatgcttacgatgtgcaaacagctgaaggtgttctttcaactatagtaaaaggggtgtctcggtggccacaggcggcccagatgaagagacctgtctgggccgcagagaggagtctggaggtagggtccaagggccacgagccagtttgggctgctggaggggggcctggcaaggagggctctcggggaagcacctgtgggggtctgcttcctgaccccagggagctagaggcctccctccctccaggccccccgagccaggctgagccagccgctaggggcacggagcagtgcccaccttgcgcccagtgtggccagagcttcggccagaaggagctcagtgcgccgcaccagcgcgtgcatcgtggcccccggcctttcgctggtgctcagtgtcccaagagcttcacgcagcggaccacccccgccagccaccgtcgggcgcacgtggccgagtgcacctacacccgcgcccaatgcggcaagaccttcctccagcagtcgacgctcacacccactactgcgcgcacatcagggagaagccctacgagtgcgccaagctctttggccgcctgtccacgctgctggagcaccggcacatgcacacgggtgagcggcccttccagtgcacgcaatgtggctgctgcttcagccgcctgtccacgctgctggagcaccggcacacacacatcagcgagaagcccttccagtgtgcgcagtgcgacaagcgtttcacgcgtctggccaacctgaccgtgcaccagagagtgcacttgggcgagcgctccttccagtgcgcccagtacagcaggagattcatgcagaagcccggcttcctgcgtcatctgtgtggccactcgcaggagaagcactatccttgcagcccttgtggtgagagcttcacctgtccctcctggcttgtgcgtcaccaggacagccatgctagccaggcctctccatcttgcctggtttgtgagagggactcctcgaccgatgagccgcccacgggcctcaggggtgcagtgtgggggagcacccctagtaatccttctgccgcactcagatttgagggcactggtacagagctgggcctcaggaggtgccctggggacaggcagcggggcagtggtgatcaggaaggtcttgggtgggggtcccttgcccagttctctttctcgcgtgaagatggagaatgtgggtagcacccagagagctccctaaaggggctctgagggcccaggggcagttggtgccccttaaatctgagcaacctctcctgggggccacttcttggccaggtcaaagtattctggccatggtcttggcttcccgggggagggctgttctcccaggcactgagattgcccatgggccttctcgttgcagggaggcggctgggatagaggccagtcccaaacacctgagcctcactgaggggaaggcctgggcttggagatggggtgcgcaggagtggctggctttgccttgttctattaggcgagtgattttcagagacaaaggtccaagttaggagacgtaattactcagtgctttgaagggacatccaaggtgctcactcttagccatagccgttggtttcctggatgctgactgtgaagattctaaagtgcttcctagggtgggcggtggtggcaggaggccttggacggagtccagggccagacccagcctcctgtttaataggctgagcccaagcgtccctcagatgcgaatccaacagccttggtgagttgtaagatttcatggaaactttccctgacttctgtctcccccttgctccccattacctgggaaaggcagctttgtgggccatgtgtcccggaagggcctgggctggctgtggcccagtgctcaggaccagccatcttggccctcacagcgccctgcccagttggtgtaatatttgtcttcaagccattgttggagcaggcaggcaaagggggctttctgaggatccaacgtgtgccagccactgggatacaaagacaggcctggttcctagctgtggggctgggaagggtatctgacatcaatggtggcacctggcagaggacacacagacaacagcaggcagcatgggctgcagtaaatgttgcagaagcacctaaaggttgagcagaagggaggtaggaaacctggacatggcctgccagcagctgagaagcccccctgagatcctggcggccccgccaccatctgaagatttaggccagtcccttgggcttttcaggcaggcccttatggtggccggccagtttgggaccctcccattttgatacattagttccccctcagctactggagatctcagccacaactgggctccagctgtgacccagactccgccaggatcccctagatcctcagctgtcagataatcccctgtccccctcctcctccccactcaacccccagtgcttgacatgaatgcatgtgtgcttcctaggactagaggccggtgctgtctctaccattgccctcactttaaggggcacacgagcagatggtagcaagccctggagagcagcactcgggttcccatgatcagtggtgaaatatagtgattttcacctgtgcttccattctgaagttctggaaagaagtactggatggactgaagtccaggacaacgtcccaaagaaaggcagagtccaggtaggcttggaggaccaagccctggatgagcactggagggcagaggcctcagtgtccagcactgtgccctgcacatggaaagcccctacgtttgtggaatgaatgaataataaaaatgttttcataagtga

SEQ ID NO: 29210 - DNA, 3253 bp, Homo sapiens
tgcacgaaatcattcttttattcctgatcctgtttcctgtttatttcatgaacttgtctgtaggcagcatggtgctgggcgctgcaggggctcattaatgcatgagacacagattccactcaggagagagaagacgaacacagacacagtacacggtgggaaggggcacttccatgtctgcagccagagagccctttcagaatctgacccaaaagatggccagtattctaagaaaaagcacatatgcttacgatgtgcaaacagctgaaggtgttctttcaactatagtaaaaggggtgtctcggtggccacaggcggcccagatgaagagacctgtctgggccgcagagaggagtctggaggtagggtccaagggccacgagccagtttgggctgctggaggggggcctggcaaggagggctctcggggaagcacctgtgggggtctgcttcctgaccccagggagctagaggcctccctccctccaggccccccgagccaggctgagccagccgctaggggcacggagcagtgcccaccttgcgcccagtgtggccagagcttcggccagaaggagctcagtgcgccgcaccagcgcgtgcatcgtggcccccggcctttcgctggtgctcagtgtcccaagagcttcacgcagcggaccacccccgccagccaccgtcgggcgcacgtggccgagtgcacctacacccgcgcccaatgcggcaagaccttcctccagcagtcgacgctcacacccactactgcgcgcacatcagggagaagccctacgagtgcgccaagctctttggccgcctgtccacgctgctggagcaccggcacatgcacacgggtgagcggcccttccagtgcacgcaatgtggctgctgcttcagccgcctgtccacgctgctggagcaccggcacacacacatcagcgagaagcccttccagtgtgcgcagtgcgacaagcgtttcacgcgtctggccaacctgaccgtgcaccagagagtgcacttgggcgagcgctccttccagtgcgcccagtacagcaggagattcatgcagaagcccggcttcctgcgtcatctgtgtggccactcgcaggagaagcactatccttgcagcccttgtggtgagagcttcacctgtccctcctggcttgtgcgtcaccaggacagccatgctagccaggcctctccatcttgcctggtttgtgagagggactcctcgaccgatgagccgcccacgggcctcaggggtgcagtgtgggggagcacccctagtaatccttctgccgcactcagatttgagggcactggtacagagctgggcctcaggaggtgccctggggacaggcagcggggcagtggtgatcaggaaggtcttgggtgggggtcccttgcccagttctctttctcgcgtgaagatggagaatgtgggtagcacccagagagctccctaaaggggctctgagggcccaggggcagttggtgccccttaaatctgagcaacctctcctgggggccacttcttggccaggtcaaagtattctggccatggtcttggcttcccgggggagggctgttctcccaggcactgagattgcccatgggccttctcgttgcagggaggcggctgggatagaggccagtcccaaacacctgagcctcactgaggggaaggcctgggcttggagatggggtgcgcaggagtggctggctttgccttgttctattaggcgagtgattttcagagacaaaggtccaagttaggagacgtaattactcagtgctttgaagggacatccaaggtgctcactcttagccatagccgttggtttcctggatgctgactgtgaagattctaaagtgcttcctagggtgggcggtggtggcaggaggccttggacggagtccagggccagacccagcctcctgtttaataggctgagcccaagcgtccctcagatgcgaatccaacagccttggtgagttgtaagatttcatggaaactttccctgacttctgtctcccccttgctccccattacctgggaaaggcagctttgtgggccatgtgtcccggaagggcctgggctggctgtggcccagtgctcaggaccagccatcttggccctcacagcgccctgcccagttggtgtaatatttgtcttcaagccattgttggagcaggcaggcaaagggggctttctgaggatccaacgtgtgccagccactgggatacaaagacaggcctggttcctagctgtggggctgggaagggtatctgacatcaatggtggcacctggcagaggacacacagacaacagcaggcagcatgggctgcagtaaatgttgcagaagcacctaaaggttgagcagaagggaggtaggaaacctggacatggcctgccagcagctgagaagcccccctgagatcctggcggccccgccaccatctgaagatttaggccagtcccttgggcttttcaggcaggcccttatggtggccggccagtttgggaccctcccattttgatacattagttccccctcagctactggagatctcagccacaactgggctccagctgtgacccagactccgccaggatcccctagatcctcagctgtcagataatcccctgtccccctcctcctccccactcaacccccagtgcttgacatgaatgcatgtgtgcttcctaggactagaggccggtgctgtctctaccattgccctcactttaaggggcacacgagcagatggtagcaagccctggagagcagcactcgggcaagtgaggtggctctggcactgcccctggactttcatgtttgtagcttgagctggttttaattggaagctctgtgatttacataatcacttacaatctctgtaaataaggaactatttatgaggaattgtaaatttcctctctcccccttcttaccctgtctgtgatcttgtctgtgatgcagtaatgatattccactctaggttcccatgatcagtggtgaaatatagtgattttcacctgtgcttccattctgaagttctggaaagaagtactggatggactgaagtccaggacaacgtcccaaagaaaggcagagtccaggtaggcttggaggaccaagccctggatgagcactggagggcagaggcctcagtgtccagcactgtgccctgcacatggaaagcccctacgtttgtggaatgaatgaataataaaaatgttttcataagtga

SEQ ID NO: 29211 - DNA, 1552 bp, Homo sapiens
tgcacgaaatcattcttttattcctgatcctgtttcctgtttatttcatgaacttgtctgtaggcagcatggtgctgggcgctgcaggggctcattaatgcatgagacacagattccactcaggagagagaagacgaacacagacacagtacacggtgggaaggggcacttccatgtctgcagccagagagccctttcagaatctgacccaaaagatggccagtattctaagaaaaagcacatatgcttacgatgtgcaaacagctgaaggtgttctttcaactatagtaaaaggggtgtctcggtggccacaggcggcccagatgaagagacctgtctgggccgcagagaggagtctggaggtagggtccaagggccacgagccagtttgggctgctggaggggggcctggcaaggagggctctcggggaagcacctgtgggggtctgcttcctgaccccagggagctagaggcctccctccctccaggccccccgagccaggctgagccagccgctaggggcacggagcagtgcccaccttgcgcccagtgtggccagagcttcggccagaaggagctcagtgcgccgcaccagcgcgtgcatcgtggcccccggcctttcgctggtgctcagtgtcccaagagcttcacgcagcggaccacccccgccagccaccgtcgggcgcacgtggccgagtgcacctacacccgcgcccaatgcggcaagaccttcctccagcagtcgacgctcacacccactactgcgcgcacatcagggagaagccctacgagtgcgccaagctctttggccgcctgtccacgctgctggagcaccggcacatgcacacgggtgagcggcccttccagtgcacgcaatgtggctgctgcttcagccgcctgtccacgctgctggagcaccggcacacacacatcagcgagaagcccttccagtgtgcgcagtgcgacaagcgtttcacgcgtctggccaacctgaccgtgcaccagagagtgcacttgggcgagcgctccttccagtgcgcccagtacagcaggagattcatgcagaagcccggcttcctgcgtcatctgtgtggccactcgcaggagaagcactatccttgcagcccttgtggttcccatgatcagtggtgaaatatagtgattttcacctgtgcttccattctgaagttctggaaagaagtactggatggactgaagtccaggacaacgtcccaaagaaaggcagagtccaggtaggcttggaggaccaagccctggatgagcactggagggcagaggcctcagtgtccagcactgtgccctgcacatggaaagcccctacgtttgtggaatgaatgaataataaaaatgttttcataagtgaaacaaaaaaggggccgctcagtaccctggggggccagttccccttcccgttccttcagggcccaaggcggaaaacagcgggcggtacagcgacggaagcgccggccggaaccctgggggcacggcgcaccaatacgcgggaaaagtgccacccgcggcgaacagaca

SEQ ID NO: 29212 - DNA, 445 bp, Homo sapiens
accccaaaaaactttggaagaagtgtacacagtatgcccatctttgcccattctcagtttctttgcaaactgagtgttgtctcaccaaactgaaaagctgtggaagggaaagagaagtggttcaggacacttggttgttaactgtaagaaaaacagcttcccttcgccaggcgcagtggctcacgcctgtaatcccaacaatttgggaggccgaggcgggtggatcacctgaggtcaggagttcaagaccagcctggccaacacggcgaaaccccatctctgctaaaaatacaaaaattagtcgggcatagtggtgcgtgcctataatcccagctactagggggactgaggcaggaggattgcttgaacctgggaggtggaggttgcagtgagccaagattgtgccactgcactccagcgtgggcaacagggcgagactccatca

SEQ ID NO: 29213 - DNA, 967 bp, Homo sapiens
gcgcaactccacctcccgtctgatccccgggcgcaagccctgtctcctcccaccccgccctcctacacatgctcctcccctttcaaaaaaaaatattcttttcatccactttgataacggggtttctcccacagcagagatttaaaagggacaggaaaatctggaatagcatcttcaactaaagatgtcaaagcacaagctcacttcccacggaaggtagcaattactattatctacttgacagctacaagaacctaggcacagaggttaagtgctctgcaaatactaccagccagtggtggttttcctgccagaaccaagttcttgccttccagtggacaccattgatctctcaagatgattctttaagttaaaaagcacgaatcacaaagggcctcaaaaccacattaaaatttaagattgatctgctcttctgcttctgaatgtgagagcctatactggatctctgaagaaaataaagatgagatgaggttctgatcccttggacttcatgaagttacgtgacagaaagtatgattgtctagccgatacttgactgtgtgaaaccttcatctactccggaatcctgaggcacagactcagaggccctctgactcacgattagggttgtcagggtgatgcaacagcaagaccatagcctttggtgtcggaataccaagttttgaagctcagtttccccactcactaattttcagtgagcacatacataatttgaaatctgaaaatggacaataatgcctacctacttcaaaatttggtttgagaatcaagtgaaatattaatatatatgtaagcattttatgaacaaggaagcaagttataaatgcattatcttgttaatttagtcatttcactaggggtgggtccaatgtgggcctcctttgaggtagactgtatttcatgaatttataataaaattctaaagtttaacaaagacaaaaaaaaa

SEQ ID NO: 29214 - DNA, 922 bp, Homo sapiens
tcctcgctggggcgcggggcactgaagggagggagagactttctcctccttcctgttccccgggacagctgtgctctccgaatccttcccttcttcccagcccacttattccccgctcgccaagcatcttcaactaaagatgtcaaagcacaagctcacttcccacggaaggtagcaattactattatctacttgacagctacaagaacctaggcacagaggttaagtgctctgcaaatactaccagccagtggtggttttcctgccagaaccaagttcttgccttccagtggacaccattgatctctcaagatgattctttaagttaaaaagcacgaatcacaaagggcctcaaaaccacattaaaatttaagattgatctgctcttctgcttctgaatgtgagagcctatactggatctctgaagaaaataaagatgagatgaggttctgatcccttggacttcatgaagttacgtgacagaaagtatgattgtctagccgatacttgactgtgtgaaaccttcatctactccggaatcctgaggcacagactcagaggccctctgactcacgattagggttgtcagggtgatgcaacagcaagaccatagcctttggtgtcggaataccaagttttgaagctcagtttccccactcactaattttcagtgagcacatacataatttgaaatctgaaaatggacaataatgcctacctacttcaaaatttggtttgagaatcaagtgaaatattaatatatatgtaagcattttatgaacaaggaagcaagttataaatgcattatcttgttaatttagtcatttcactaggggtgggtccaatgtgggcctcctttgaggtagactgtatttcatgaatttataataaaattctaaagtttaacaaagacaaaaaaaaa

SEQ ID NO: 29215 - DNA, 431 bp, Homo sapiens
gcgcaactccacctcccgtctgatccccgggcgcaagccctgtctcctcccaccccgccctcctacacatgctcctcccctttcaaaaaaaaatattcttttcatccactttgataacggggtttctcccacagcagagatttaaaagggacaggaaaatctggaatagcatcttcaactaaagatgtcaaagcacaagctcacttcccacggaaggtagcaattactattatctacttgacagctacaagaacctaggcacagaggttaagtgctctgcaaatactaccagccagtggtggttttcctgccagaaccaagttcttgccttccagtggacaccattgatctctcaagatgattctttaagttaaaaagtaagataactcaaatttctactttctataataaaagtgcccaatcttaaaata

SEQ ID NO: 29216 - DNA, 386 bp, Homo sapiens
tcctcgctggggcgcggggcactgaagggagggagagactttctcctccttcctgttccccgggacagctgtgctctccgaatccttcccttcttcccagcccacttattccccgctcgccaagcatcttcaactaaagatgtcaaagcacaagctcacttcccacggaaggtagcaattactattatctacttgacagctacaagaacctaggcacagaggttaagtgctctgcaaatactaccagccagtggtggttttcctgccagaaccaagttcttgccttccagtggacaccattgatctctcaagatgattctttaagttaaaaagtaagataactcaaatttctactttctataataaaagtgcccaatcttaaaata

SEQ ID NO: 29217 - DNA, 665 bp, Homo sapiens
gcgcaactccacctcccgtctgatccccgggcgcaagccctgtctcctcccaccccgccctcctacacatgctcctcccctttcaaaaaaaaatattcttttcatccactttgataacggggtttctcccacagcagagatttaaaagggacaggaaaatctggaatagcatcttcaactaaagatgtcaaagcacaagctcacttcccacggaaggtagcaattactattatctacttgacagctacaagaacctaggcacagaggttaagtgctctgcaaatactaccagccagtggtggttttcctgccagaaccaagttcttgccttccagtggacaccattgatctctcaagatgattctttaagttaaaaagagctgaaagcctgcaaactacattttgttaagtctttggtaaacacatttcatattaatttctgttacaaggcagcagaaataggcacagtgcctccaacatatcaaaggaaagtaaaggctagtggaaggggataacagcttcctgacctccaggtccaatggaaaagtcccattacgttgactaggacccacacttgtgaagaattatgaaaacacagagcattttgcaacaaattatgtaatcatgtaaatagtaaactaataataaacagtaaactgataaca

SEQ ID NO: 29218 - DNA, 702 bp, Homo sapiens
tcacagtaatgctagtgtcatagaatgaattgggaagtattctcttctcttgaattttctggaagagtttgcatataatcatattatttcttccttaaggaagaattctacgtttgttagaattcaccagggaagccatctgggccaagagttttccttacgagaacacttttgacgataaattcaatttctttaataggcatagggatactcgggttatttatttcttgctgagtgaacttggataattgttgtttttgagtaatttgtctatttcattgaagttgattttgatagaaacatacataatattccctgattttctttttaatatccaagggatgtgtagtgacgttgtctttctcattccttgacattggtgatctatatcttattgcttttttcctgatcagtctggctagagtttaattaattaattttttcaaagaaacaccttttgattttatttttttcctatttttgtcttgttttgtttacttcgttgatttctgctctgatctttatttcctttcttgttatttattatttttcttcctctagttcctaagatagcttttttctttattttcttattttatttttcatttttgagacagagtctcactctgtcacccaggctagagtgagccgaggtcatgccattgcactctagcctgggcaacaagagtgaaactccaactc

SEQ ID NO: 29219 - DNA, 415 bp, Homo sapiens
cctatacatcaatcacatagcaacaattgtcaacattttactgttttctccatctcactatatataaaatctgtggctaaagcattttaaagctaattacagatattctaacacttcaaccctaaacacttcagcatgtatttccaaaaattagatcattctcttccataacaatacacttaacacgtctcacaaaattagcaataattttcttatatcatctaataccaagttcatagtgaaatttccccattgtctaaagcatggtgggccaggtatagtcgcttacacctgtaatctcagtgctttgggaagtcaaggtgggaaggtggcttgaagctaggagttccaggccagcctgggcaatgtagtgagatgtcatctctactaaaataaaaaaaaaaaaatggccagg

SEQ ID NO: 29220 - DNA, 410 bp, Homo sapiens
tgagatggagtttcgctcttgttgcccaggctggagtgcaatgacgcagtctcagctcactgaaacctccacctcccgggttcaagcaatcctcctgcgacagccacccaagtagctgggattacaggtgtccgccaccatgcccaactaacttttgtatttttagtagagacgaggtttcatcatgttggccaggctggtctcgaactcctgacctcaggtgatccacccacctctgcttcccaaagtgctgggattacaggcgtgagctaccaggcctggcctcttcttgcctcttaatgttgaaatgactcagttcttagtctgtggtctcctctttatttaccgtcactcccctggtgagctcatgcagttccatgccatatagttggtatttaaagtaaactccc

SEQ ID NO: 29221 - DNA, 342 bp, Homo sapiens
tttttgagacggaatcttgctctgtcacccaggctggagtgcagtggcgtgatctcagctcactgcaagctccgcctcccgggttcacgccattctcctacctcagcctcctgattagctgggacaacaggcacccgccaccacgcccagctaattttttgtattttttagaagagacggggtttcaccatgttagccaggatggtcttgatctcctgacctcgtgatccgcccgccttggcctcccaaagtgctgggattataggtgtgagccaccaaacccggcccctctaacaacaattttatgaggtaactattatcaatctctttcacaggtcgacg

SEQ ID NO: 29222 - DNA, 485 bp, Homo sapiens
gatggtgacagagtacaataaaagtagggaaattcttcgattggggtgcaatgagccatatattgcccaccacctgaatgcggtagttggtgtgaaagaactcatttaaaagtttttcactggtactaagttctgaagccatagtttgacaaggtgggtcaaaaataattgataaatgctcagtttggtagagtaatttgagttctgctccttctagtcactgctttttctcccccttgtttttcttcttttcatcatatgtacgtcagagacctgtgttattggatataccctgcctaagtaactggatataccctgcctaagtaactggatatgcttgggccacatcgggttaatctctttggatcatcattgtatacgaaactactgaggaaacgtatacagccactgtttaaggccttctcagtccgtggcagaaagtagtgtctctcacttaacttgattaaacttggacacttggggtc

SEQ ID NO: 29223 - DNA, 458 bp, Homo sapiens
cgagtaggggactgtgctgtgctgatgtcctgagccaccctgcctggttgagtgtgttgacctgggttgggggaaaaagccttggaatcagatttaaactgcagttcctcccaggttgtcatgttgtgtgactgcagaggacaaagcttcactccccaaaagtcgggccgggatggagcgcagtggctcacgcctgtaatcccagcactttgggaggccaaggcaggcggatcacaaggtcaggagttcaagaccagcctgaccaacatggtgaaaccccgtctctactaaaaataaaaaaattagctgggcatggtggcgcacacctgtaatcccaggtacttgggacgctgaggcaggagaatcacttgaacccaggaggcggagcttgcagtgagctgagatcgcgccactgcactccagcctgggaaacagagtgagactctgtctcaaaaaaa

SEQ ID NO: 29224 - DNA, 316 bp, Homo sapiens
cgagtaggggactgtgctgtgctgatgtcctgagccaccctgcctggttgagtgtgttgacctgggttgggggaaaaagccttggaatcagatttaaactgcagttcctcccaggttgtcatgttgtgtgactgcagaggacaaagcttcactccccaaaagtcgggccgggatggagcgcagtggctcacgcctgtaatcccagcactttgggaggctgaggcaggaggatcgcttgagcctgggcagttgaggctgcagtgagccatgatcacgccactgcactccagcctgggcaacagcgagacccagtctc

SEQ ID NO: 29225 - DNA, 377 bp, Homo sapiens
tgaaaaagcatttaaaattgaaagtaaaaggacctataaattcctgttaattttagtaaagaagctataaatttctgttaattaaagctgtcttaatggaacaaatatagcttaaagtacaggctatgaaaaaaatcaagaaagatttaaaaaatggtttcagcagttaagtcaagcagctagcaaaaaaattatggagataatagaaagaccaaaacaaaggagacaattaagcgtaaaaactaactggtggggagcagtggctcaccactgtaatcccaggactttgggaggctgagacaggtggatcacctgaggtcaagagttttagaccagcctggccagcatggtgaaaacctatctctactaaaaataca

SEQ ID NO: 29226 - DNA, 704 bp, Homo sapiens
aaggacatttgaatgttctgggtaagactcaaacttcaaccagatgcaccaggttctttctttcttatcctccaacttaattgctcagtgtctgtattctgcttgtgtcataacgtctctttcagtctaagaaaaatgactctaagtggctgtacttaaaaatgagaaattgtggggtaatttttgaggctgtgtctgatgaaataactacatttgaatgtggccagttggagacacaaaaaaagaaagagtggccagtcgtatcggtcgatggttgtcattcaagcttcaggcacacaaaggcagtacgctttgaacagtggccttaactccacctgaacttcccaaaagggcctttcgtctggggaaacatcaaagttgcttttgaaactcttgtgttttctcttccaaggtgagaacaaagcatcagaaaggcacaaatactaaaagcttccagcctctaagaaagagggaagggcaaatacattcctaagttactaatgtaataaaagccagaagagttcttcaagaattctaggggtagtgacgcatgccagacaagcccagccctgaggaatacttaaaagcgactcgcggagcatgcgcctcagaagtgccatgctttccactggggaatgggaacttgtaagttactgtggctctatattaataaaagtggaaattaaaatgttttgatatagccc

SEQ ID NO: 29227 - DNA, 426 bp, Homo sapiens
cccattggtattactcactgactaatgtcggtttggcttcctattcttaacgttaccattattacctcagtgtgggatgtacagacccatggggcaggcacagtactgctagcctgcgctccgtttcttcaaaacaccgttagcgatctgatcatctctactttagtgcctagagttcataagagaaggtgacaataaaaactggagcattgaaatgagcttactatgtaatcataactgtccctgagcattggtttaatattataaagctttggaaatatgttatcccattgcactcagagacattacaaagaacacttttttattgttgttgctgttattactactattgagatgggaaatttgataacataaggaagttaaaataatgcgtgcatcttataaattttaaaaccgatctactgg

SEQ ID NO: 29228 - DNA, 368 bp, Homo sapiens
cacctcttgttgcctgtctgtccttaatctttttaagcctcagtttccttagctataaaatgggaatgactccttgagccatagctagtaggatcatttagaaattaaatgtaatttaaaacatttaatagagggttttgacacatttaataaattctaaaatgttagccattgctgctactatgtaagtgagtgtgcaaggaagtcctacctttttggcctttttgctttcataattttaaactaaggctgggcacggtggctcacgcctgtaatcctagcactttgggaggctgaggcaggtggattacctgaggtcaggagttcgagaccagcctggccaacatggcaaaaccccgtctttacta

SEQ ID NO: 29229 - DNA, 392 bp, Homo sapiens
cacctcttgttgcctgtctgtccttaatctttttaagcctcagtttccttagctataaaatgggaatgactccttgagccatagctagtaggatcatttagaaattaaatgtaatttaaaacatttaatagagggttttgacacatttaataaattctaaaatgttagccattgctgctactatgtaagtgagtgtgcaaggaagtcctacctttttggcctttttgctttcataattttaaacaaagtgctgggattacaggtgtgagccacagcgcccggccccttgctactatctttaatagctgtgtaatcttaggcaacagtatataacattggctttcaattttctcattgcaaaccatgtaaaatgtcccccattactgcagtat

SEQ ID NO: 29230 - DNA, 753 bp, Homo sapiens
  misc_feature (468)..(468): n is a, c, g, or t
  misc_feature (472)..(472): n is a, c, g, or t
gcgacggttagataagctgattctgatgttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaancaantatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatccctggtgtctccaacctgactaggtggacagagctcaaagaggccctcttaccgctagcgaggtgataggacatctggcttgccacaaaggtctgttcgaccagacatatcctagctaagggatgtc

SEQ ID NO: 29231 - DNA, 215 bp, Homo sapiens
aaataaataagatatataaagagaacatattatccgcgtattggtaaataacttctatttagtaattctaaatagtaaagttagactaccattctacacggcatttctaggtgtggtagttcatgcctgtaattgctttgggaggccaagctgggaggatcattaagcccaggagtttgcaccagcctgggcaacacagaaagaccctgtatctg

SEQ ID NO: 29232 - DNA, 365 bp, Homo sapiens
tttaggggtgtccctgtttgtccaatcaatatagaaggtggtgaaacatttataagtgtttctgggtaacactttacccttgctttcatgtaaccggggaataagtttctgaaattccgcctaacttttttcaatttaccagtccttaccccacccacctcctttccttccaccctgtgttctgcaacctttctttgatttttctttatttcaccttttataattttgttttcatttctgaccctctccccataacacacaagaccctttagatgagcctaaataaatacagaaatagacttaaagcattaaatgcttttttaagaaaaagttttgatgtgtcatcctccatagttaaaaaaaaa

SEQ ID NO: 29233 - DNA, 1200 bp, Homo sapiens
ggcccgcgtgtatagaggatcccgtctgagcacgctgggaactctctcctgatggagttctgcacagcaggtctttggtatcccgcccccaccccagggtcttactctttctcctgtctcactctcattgcctcatgccttcctgcccctccgctctggaagtcttccttgacgctcttctgcccagcctcagtctccatgtggtgctgctccattgtcttcacataaatactagacgtgcattgctagccctgtcttagtgctttatgtactctcttaggatgtatgtctacttcccttatgagaacaggtgctttttaaaacagaaaataatttgctcactaataaaagactaatcatattttagaatctttttccattgtgtattttatttatcagacttatttgtagatttgcttcatatgaaagtgtggagggtgtgcgcagcctcattatcagcatgtcagttccagttcagcttgctccttctctgtccccggtgcccagcctagaagagacttctagcaaatgtttgttgacttaagtattacccttcaagcccatgtcaaaactgggcaccatttcgtgatttcccatccctctctcccttctacctcctgtcttgctggatgaggtctctcctgtggctctacttttatatcatattcttccttggattatgtttttggagtagttatctattgtactgaaggggtatttgggcaagcagttgttggtatctctttaatctccacagcaatcaatagttatttgcataccttacgcatttgtatctactcaactgagtgtgtttaatgtccagaaatcagatgcctaagaaacaacttccttaggtggaagttcagcccttcatctctcatttcatttttagtttatgaaattaacttttgtctactgttcctcaaactagttctttgccaaaggaaaaagccgcctaacttttttcaatttaccagtccttaccccacccacctcctttccttccaccctgtgttctgcaacctttctttgatttttctttatttcaccttttataattttgttttcatttctgaccctctccccataacacacaagaccctttagatgagcctaaataaatacagaaatagacttaaagcattaaatgcttttttaagaaaaagttttgatgtgtcatcctccatagttaaaaaaaaa

SEQ ID NO: 29234 - DNA, 525 bp, Homo sapiens
  misc_feature (7)..(7): n is a, c, g, or t
cccgggnctgcaggaattcggcacgagcaatcatcaggtaaaaataaaataaaataaaataagatcagtagagtagaaaatcttccaagagcagagggagttcttccttagcaatgaaaaaaagacaaaaaaaaagggtaaatacataattaaatagttaattaaaaccctaaccatgaggggcttagaagattttttgataaaagacaaatgttgctgtcattttctttgtcaattagaaaacagtggtagtttctacgttgcatctacatttcagactaaatgattattgtacccagttatggttgtttgctaatattttgtctctctctctttctctctgtccgatgcttcttctgtatttttgtgtgtagcaacaaaaacgtgtaatgcattaggcattattctggtttgtttctgagtatctcctgtactgcattaaggtttctttcatttattttaagcttcgctactgttctcactttatgccgtgcaatatcatctgctgtgtttgctaagcaaaaa

SEQ ID NO: 29235 - DNA, 1828 bp, Homo sapiens
aagtagagtgtaaaaactcagagagacaagctaacttgaatttggaaatcctctaggttttcccaagtttctgaattgcttcaaggcagggggcagggcatggagacacagttccttttgcaaagctgagaggagagtgtaatggcctcatgcccttaagcagaaagtcaaggctggggagcagctgacccagcccctacccctctggccagtccacagtagacacaaaatacaattgcttggcctcaattatcaatagaatttaagagaaaaatcaaagttacacatccctctccacatcagtttcttggaatctgctactcatgactgcccctcctctccccacgcgcccctaccaaagtcacaggagtcatcctcaaatgtcagggtactggggtgaatgtactccacgcctctctgagtttgtctctgctcactcttcatcttcccactggtttcttttctgcactagagatgatccctgccctcagctcccttcatggaggcagttcagatacttggccctacctgtgatgagcacacacacagaattctcaactgacagtggcatcctcagaagagtcggtgcccactattttgttttattttgctgaaagaagttgccctcactacacatcataaacccatagatgtaaatactttccctctcaacatacaaattttacctttctctttccctcccacaggggtgactgtggtggggaaggaaagagagggcttagacttcaggtcaaatgttacattttcttaggaacatttttatactcattatgtattttaataggggcaataaatctgctttgggttgcaggatcactcagtgttctgttggaaagcattgaccaatgatttgtttttaatacaaatgctgtgcgatgagttatagaaacctaggacaatggttgagggagtcgactcctacatcagcagtgaagcgctgagcggcgttgtattcacaaagtcacatcttctgtttctgtgttagtctcgatttgttgtggtacgttctgcatttattacataatcattgtgggctcattttagatttgccatctgaaccaagtgacaagtatttttcaatacaataaagttgaaaaccttgtcttccacttgctttggtagttgtcttcatatctccctgtgcttattgccctgtctgaatcagcccatctgtcactcacttagacctatcccttccccactttttctactttcactacacttttgaccttagctattgtttgagtgtgactcagtttccctgttcaagttagcttgatggtttattatgtaaggagggtgcctaagacaatcatcaggtaaaaataaaataaaataaaataagatcagtagagtagaaaatcttccaagagcagagggagttcttccttagcaatgaaaaaaagacaaaaaaaaagggtaaatacataattaaatagttaattaaaaccctaaccatgaggggcttagaagattttttgataaaagacaaatgttgctgtcattttctttgtcaattagaaaacagtggtagtttctacgttgcatctacatttcagactaaatgattattgtacccagttatggttgtttgctaatattttgtctctctctctttctctctgtccgatgcttcttctgtatttttgtgtgtagcaacaaaaacgtgtaatgcattaggcattattctggtttgtttctgagtatctcctgtactgcattaaggtttctttcatttattttaagcttcgctactgttctcactttatgccgtgcaatatcatctgctgtgtttgctaagcaaaaa

SEQ ID NO: 29236 - DNA, 977 bp, Homo sapiens
gctactactactaaattggcggaagaacgcaccaaatgctgtgcgatgagttatagaaacctaggacaatggttgagggagtcgactcctacatcagcagtgaagcgctgagcggcgttgtattcacaaagtcacatcttctgtttctgtgttagtctcgatttgttgtggtacgttctgcatttattacataatcattgtgggctcattttagatttgccatctgaaccaagtgacaagtatttttcaatacaataaagttgaaaaccttgtcttccacttgctttggtagttgtcttcatatctccctgtgcttattgccctgtctgaatcagcccatctgtcactcacttagacctatcccttccccactttttctactttcactacacttttgaccttagctattgtttgagtgtgactcagtttccctgttcaagttagcttgatggtttattatgtaaggagggtgcctaagacaatcatcaggtaaaaataaaataaaataaaataagatcagtagagtagaaaatcttccaagagcagagggagttcttccttagcaatgaaaaaaagacaaaaaaaaagggtaaatacataattaaatagttaattaaaaccctaaccatgaggggcttagaagattttttgataaaagacaaatgttgctgtcattttctttgtcaattagaaaacagtggtagtttctacgttgcatctacatttcagactaaatgattattgtacccagttatggttgtttgctaatattttgtctctctctctttctctctgtccgatgcttcttctgtatttttgtgtgtagcaacaaaaacgtgtaatgcattaggcattattctggtttgtttctgagtatctcctgtactgcattaaggtttctttcatttattttaagcttcgctactgttctcactttatgccgtgcaatatcatctgctgtgtttgctaagcaaaaa

SEQ ID NO: 29237 - DNA, 272 bp, Homo sapiens
cagactgtctccactccctctcgctctcctgctagaatgcgctaggagggtgttggtaggggctaggggcccaaggacagagagcttgggtttcccaacagatcagcccaggaaggatctggctgagaccagagaaacgctttttcctgaatcaagagacctgctaggagcaacagcccctcctctctggacactgtgatctgcagggccctgagggttaccaggacgagagtgtcaacctgttttggggcaataaaaggctgtgaaggagc

SEQ ID NO: 29238 - DNA, 418 bp, Homo sapiens
gttgcagtgagccgagattacagcactacactcctgcctgggtgacagagtgagactctgtctcaaaaaaatagaaataaaaataaaataagttattgtgctgggaagacctttaaaattacttctaactggtaaaaaccttttggaagaattgttgttattactttaaaaaaatttgtcagtttctaagcccctgagcaagacctgataaatacaattagaagaaatgtgtgggctggttcagcctctgcttgggaaacataccctgtgtagggactgagggaaaagaattactgggtggaatttcatttctgtagtgcagtgggttggtgaagctctgtggaggggtttttaaagtccattgattgtattgagtgactcgccacatacacatgtgtaataaagaggtttcattaga

SEQ ID NO: 29239 - DNA, 331 bp, Homo sapiens
aaaattaatatattccaactacacttcaataaaataaattttttttgtgtgacaaggtctggccctgtcacccaggctggagtgcagtggtgtaatctcggctcacagcaacctcagcctcttgggctcaagcaatcctcccaccttagccttctggctacaaaaaaaaactgaaacagctaatgacttcaatgctgggtgtggttttaggagctaaaatgttgatagtaggagccaggcatggtggtacccgtctctaattccacctacttgagaggtgaggtgggagaatcacttgagcccaggagttcaaggccagcatgggcaacat

SEQ ID NO: 29240 - DNA, 487 bp, Homo sapiens
ccaaacattcttcaaaactgctggatgcttgcttttctttacataactgcagttcagttggaggagtgagagaagtgaagctaatatttacagagagtacctactatgtgtcagatactttgcaatgtgctttacagaaatacataatcacattctttaaacaaccctttgaggttgatgccttaattcccattttgtagataagaaattgagtccagaattaagttcagataatttgcccaaagccatagagttttcaagtcataaatttgatcttagacctttctagttgccaaggccttcctacttagacagaatccatttggagagaaaactttctaacattcttctaagaggtcttgattcttggcacattcttctgtgtgatgtgttctctgtcaggcttgtcattataggggcaggaagaacgcactcatttcacttatacatatctaccattgggatgtgttagtagtgggaaagtaaa

SEQ ID NO: 29241 - DNA, 510 bp, Homo sapiens
actcccaaactcaatctagcacttctacgtcagtctgggtctgagcttgggtgaacatcaccagctgcctgttcccctctgaccaccaatttgctgtgatcggatcaagacagaaatatgccaggtgggcctcaaagttggtcagtcctccttaacctgcagtggcctccaagcaatgcaggatgctgactcaaggagatgcacctcgtttgggaagctcaggaaaaccatgctgttagtactaggactgtacgtctgaccaccccagctctgtccaccttccccaaaagtctcttaactggggatgaaaagcaatccactccaggaagtggaggccaagctgggaggagacattgattgagaggtttttcccacagaaagcaagaaagatggccaggcatggtggctcatgcctgcaatcccaacattttgggaggctgaggcaggaggatcacttgaggccaggagtttgagaccagccaaaaccacatagtgagaccccgtttctac

SEQ ID NO: 29242 - DNA, 747 bp, Homo sapiens
ttcttacagtcctggccagtggctatgagaaggaaaagctcagagtacaggtgacttccttcttttgggatatattcactctgctctgtaggagtaaacaggagaatttcctcctattccacaatgctgaaatttctctcattttatgctgctgctggtcagaacttataaaagagtgagaattatctatgagggctcaaaaggtgaatataacgatcatttctcacatggcaaagtgttatttcttatggcagcatttctgagtgtttcgtatacacctagaggttagttcatagattttaccacaaaaagattggtctcaccgtcaaataactggggaatgctgagttccatacacagacagggttctgtagaagtcctcagcttttgatcagctaatatgcattttctgtgcaaaagaaaggggaatatacagctctacccacactttgttgccccttgtctctaccctgcatacatacccagcaccacactgaacttgaatatgacaagacttcgcttcaggaaatgctgccctccaggcctcttgcttgtcttttacttttgtttatactttcttttgtcatgtagaagtttaaatttttgatgttgtcaagtgtacttgttattttatttattatttttactttggcttctaaaaataaagacccttccctaacttcacaaagatattgtgtttgtgagaaaagaataaattttctttaaaaacttttttttaactccttc

SEQ ID NO: 29243 - DNA, 310 bp, Homo sapiens
agagcttttcccttctcagctctcatgctgtatctctgggatctagttgtcagaaatatagcccacacattgggctattttaaagagtgtaaaatatttttatgtggtaagtataaaagggaagtaagttacatataagtaaatttcattttatttggatagcctaggataaatttaaaacataattttcttctaagtagatctaaattaaccacttcttgtagcctgaaaccttgggattgctgaggtatcatggtccctttcctgttttaaggttcagctctccctggttattttttttttttttttt

SEQ ID NO: 29244 - DNA, 897 bp, Homo sapiens
cttggctatgacatggagaagcatctatctgtaaaatcatattatattactgtggttgttagcaaaccacagtaatataatatgattttacagatagatgcttccccttggctatgacatggagaaagattttcccataataataactaatatttatattaggttggtgcaaaactagttgcggtttttcccattaaaagtaataaccttactcttatacaaagtggacactgtggggagatacagagaaatggaagatacggatcctgcctggagtaggtaaccttgcttggaaaccccacatgcaaacgtcatgaggagaattaaaggagtattatcagtaatgaagtttatcatgggtcatcaatgagcatagattggtgtggatcctgtagaccctggtgttttctttgaagtgccctctcctaatgcagaggccttgaagcttacagtatacacttgaaaagtcacagatagctagaattatgatctttgaagttataactgtgatctgaaaatgtgtgtggtggtatgacagcataccattaaatacatttacatcacagctcaaaggactgtgatataatccatttatatcacaactcaaaggactgtgatataatccatttatatcacagctcacagtttctgaaaatgtataaaagaatctataatctagtactgaaattactaaattgggtaagatgatttaaatgattttaattttaacattttatttctagaatatatggctccattttattttatagtgtaaagttgtatttcctaaagtttgtgttttgtcgacagtatcttttaaatgagtcttaaaaataaaggcatattgttcatgtttttctttcctggtggcacataaatgacatgtcttaaaataga

SEQ ID NO: 29245 - DNA, 430 bp, Homo sapiens
ttatcctctcctgtttaaatgacaacagcctgctaactctggctctggtcttatcctcagctatctgtctttcagccagctgccaggctaatctctccaaagcaaaaatgtgaccctgtcacttaatagctttgaataatggctgaaacccttacctggcctataaaaccctccatcttctcccttgcctcctctccagattcatttcttggctcttctgctttgcctatcaaattgttactctgagtatactatttattattcctttctgtctttgcccatattggcctgaaatgagccctctgctgaatcccctcaattctatctgtgcactggctcctaattcattctttttttctttttttgagatggagttttgctcttcactcttgtcgcccaggctggagtataacggtgcgatctcggttca

SEQ ID NO: 29246 - DNA, 484 bp, Homo sapiens
caagctcaagggaaatgatgatccaaaatggactcagataaagtttctgccactctgcattgggggcttttggtaggagtccagttcaattttagaaaaataaaaatacatgtctcgcacttctgagtttgcagactaaggtccattctgtatttgcaaacgaggacaaaaagaaaggcggctgaatgcggtggctcacgcctgtaatcccagcactttgggaggtcaagatgggcggatcacttgaggctggccaggagttcgagaccagcctggtcaaccagcctggactttcattgtgttagggtgcctacaaatacaaaaatttagctggatgctgtggcacacgcctataatctcagctactcaggaggctgaggcaggagaatcatttgaacctgggaggcggaggttacagtgaaccaggatcacaccattgcactctagcctgggcaacaagagctaaattccatctcaaaaaaaa

SEQ ID NO: 29247 - DNA, 399 bp, Homo sapiens
ttctgcccttcaatattcaagattatatatcatgagaaattctaaaatgtatagaaatatcttgtaagaaatgttcaagtagtgacaaatggatagtccctgtgcttatggctgaatatcggataaaaataaccaagatattctcttttcctttctaatccttccacaaagtacctgatttacagtatgccttgggtaactgaaaactgcaacattcaagactagacactcttactgaggcaacaaaggtcccccagcatttataaatgctttttatttttatcctatatccttacttttatcctatatcctcatttagagagtatctggtatgattacaaagtcatcatttcattactttggtattttcaacaaataaaagtcatatatccaaatggg

SEQ ID NO: 29248 - DNA, 276 bp, Homo sapiens
gtgccaccatggccagccagaatttatgtttctgacaaccatattttgatttttaaaaagtttatgattctcatagaacagataagacaattgtattcagaagtactgaatgttaggtaatgctcataaaatatattaggactagtgtgtactgaatttactagtaggacattatttttcagatcttcaagaacattggtaagctggatgcagtggctcaagcttgtaatcccagcattttgtgaggctgaggtgggaggattgcttgagcccaag

SEQ ID NO: 29249 - DNA, 450 bp, Homo sapiens
gaggttgcagtgagccgagagtgcaccattgcactctagcctggagaacagagtgagaccctgtctcaaaacacacaaagaaatttcagatatgctcattggaatgtgagaagatattttcaactaaatttagttgcaggtttttttgttttgttttgagacagggcctcgctcttgcctgagatgaagagcagtgggaccatcatagctcacagcagcctcaaactcatgggctcaagcagtgttctcatatcagcctcctgagaacctaggactacaggtgcatgccaccacgcctagctaattttctaaatttttttttcgtaaatatggagtctccctatgttgtccaggctggtcttttgaattcctggcctcaggcgatcctcccactttggcctcccaaagtgctgtgattataggtgtgagctaccatgcccagccttaatt

SEQ ID NO: 29250 - DNA, 430 bp, Homo sapiens
gttcctcagacatcggaactcctcctcagatcacttcctgcctcccaggaccactgagactggttatggacctctgagaggagatggatgagagaatggtttataaactcagcctcttgcatctcccagagccacagtcccagcctcggccattcctgctacaaggacaagctcccaaccaacgccttggaaacccatttccctccctgcaggcctggggaggggggctcaaggtctgtgggcatgaaaacccctaaaaaaatcattctcagtgtgcagaatggccagacaaggtctcggtaactcagaaaatcgtcgtctcttctctttctctcgcttcccaggagagagagtgggaagggagaatcaagttcctgatgccttgctgggctcccagatcgacagcaccttctgcccgcctcgcaacagg

SEQ ID NO: 29251 - DNA, 272 bp, Homo sapiens
gttctctgtggtccctggataagaggcatcaccattatctggaaacatgcagtaaatgcagattcttcatcttctccccagacctcctgagttagaaattcacaagttctccaggtgatctcatacatgctaaagtttgagaaccattgagtaaagttaatgcattaagaagagattagatagggatggtggcgtatcttcctacagtttccctgttaacaagaaagtcagaggtcagttgatcagacattagattatttattgctaaaact

SEQ ID NO: 29252 - DNA, 465 bp, Homo sapiens
aggatggtcagaatctctgatgtcatcgctcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctctgttccctgtcccagcagaggctgtgtcctctccactcaaagcctgaagcatgttggggtctctttgtctctgtacatgcccatttcagagtccagtctggtgggagagggaacagagtgggaaagaaaactagggtaagcagaaatgatgaaaccttataagaagtgagattatcatgtacaagagtgagattatcatgtacaagagtgagattatcatgtacaagagatcccaggaatactgacttgatgaaaaagtcacatcagagcactcagtttggcaga

SEQ ID NO: 29253 - DNA, 219 bp, Homo sapiens
tcaatggggttcatatcccaagaattcttcattatataattttccttatataaaaattatacttatcatctgattcctcttgccctgtttcatatatggttctttttgttttttacatgttcagtacacatgtgtgttttttggggtttttgtgtttgtttgtttttttcacacagagtcttgctctgtcgcccagactggagtgcagtggctcgatct

SEQ ID NO: 29254 - DNA, 413 bp, Homo sapiens
agtttccacccagagcattttccatgcattgacattcagtaccaaagataggtacattgtggaggtttcacgtaaacaagaaactgtacctattattttgtaatttgattttactccctaacaatttattttagggatcttttcatgttagtccattggtttgaaggactgaagaatatggaggtgccagatttgttcacttagtcctttactaatggacacttaggttgttttcagtttttccccttaacaaaccatacactattaacctaggctaacaaaacactgaacaaccggcatcctattacctccaatctacaacaacagacgctccaaaggaataaaactaaggaaagtcagtctagttacctcatatcctaacatgtgttgtatatagagtactgagcccttac

SEQ ID NO: 29255 - DNA, 409 bp, Homo sapiens
actaatctctaaatggtgtgaaaagcatttcatcttgatgtggactcgattctgtagaacatggtttcccttattttcggtaaagatctgaaattagatttgtatagggtggtgtgattgaacttatcctgaagtttaatgcatgtactttctacctttttagttcagaaaatcttcagtacacagaagtggagaatagtataatgagccccttcatcataatgaatgaccactatccagtttaacaatgatcaactcagggccaattttgtttttttctaagacctcacgcccacctccattattttgaagcacattccagacaccatatggatttcatctgttaagtatgccttttttttttctttttgagcctgggcaacagagcgagattccatttaaaaaaaaa

SEQ ID NO: 29256 - DNA, 411 bp, Homo sapiens
ggaggaaactggtcactccctgtctcccccgcgcgccccccgtgccttccatggaaactgcagtgctgactttctgtgtcgcctggttgtgactccagaagtgggctcaggaaacccttgttgacgatcacccagggaaaaaatccttccaaaccctccggcggggggtgggcgagtttcagtaatttcacagtaacaaggatggacgctcctcagggagcctcttagtggaattctgattctggagccaaccacaaaatggtggcggtgggaggaatccctgtggaaatccctgacttcccatccaaaaacatctgaccctaacagtcaccgcggttgctgatgcctcagaggactgctagacccaaaggccaactcctctccatctattttaaggtaaaaatttcagta

SEQ ID NO: 29257 - DNA, 644 bp, Homo sapiens
tacaggtgtaagccactgcaccttgcctaattaaatttttaaatacctgttttcagatatgaccttatattccagaactctcaattctgtggtggccatagacttggctcaatttgatgttaaacttgcgccatttggggtttgtctgtgtgcttggcaatctttatggactgtggcattgggaatctgcattataaagcaattatttctcatagtaaaagggaaaatgatagcttggattaatgtgcaagttgggtcttctgatgaagatatgttcttatttataatttaaagctgatagaactgaactaagtccaggctcagtattagcgttcaacttaataaaggagtcttggctttcagcactaggaaacaatgatcagggagaggcatcctagtgttttggtgtgggattacaggagtttgatagaggagagcttaagatcccaagacaacttgtcaatctgtggatctgcacatcaccttgttttgacgatgtccagcactgaggttttttccccaaaagttactgctttcctatctagtgtgtgaagtttaaagttacttgtttctcttatggatgacttaattgaccttggccttgtaagtttcctgttgactgttgaataaactactgaatgttg

SEQ ID NO: 29258 - DNA, 589 bp, Homo sapiens
tacaggtgtaagccactgcaccttgcctaattaaatttttaaatacctgttttcagatatgaccttatattccagaactctcaattctgtggtggccatagacttggctcaatttgatgttaaacttgcgccatttggggtttgtctgtgtgcttggcaatctttatggactgtggcattgggaatctgcattataaagcaattatttctcatagtaaaagggaaaatgatagcttggattaatgtgcaagttgggtcttctgatgaagatatgttcttatttataatttaaagctgatagaactgaactaagtccaggctcagtattagcgttcaacttaataaaggagtcttggctttcagcactaggaaacaatgatcagggagaggcatcctagtgttttggtgtgggattacaggagtttgatagaggagagcttaagatcccaagacaacttgtcaatctgtggatctgcacatcaccttgttttgacgatgtccagcactgaggttttttccccaaaagttactgctttcctatctagtgtgtgaagtttttgactgttaataaaggaatctgtcaaccatc

SEQ ID NO: 29259 - DNA, 312 bp, Homo sapiens
ggaggtcagaagctgctaggagagagatttttccccaagtcagcaaccttgcagcattggtctctatgaggagcaactcaaattcagctagatttaaaatgctagagtcttccagtgcactagcagagtcctacacaagagcctgagacaagaaaagacagaggcgaacgacacgtatcagcattcttgggatcatacacccactctcattctcctaacagtcattcagcttttgatttcagcattgaccaattcagcagaaatttctacccagaaccagtgatttcaggcctcttaaaaaccagtggtatt

SEQ ID NO: 29260 - DNA, 147 bp, Homo sapiens
acagcttggtttcctgctgctgtccagctcacccaaccacagttcccatttggcccaccatgtcccttcatactggatttcatctttctgtgacagaggcacattgtcacctttcaaattcacattcttaacttatctttcaaaata

SEQ ID NO: 29261 - DNA, 378 bp, Homo sapiens
tttttagacagagttttgctctgtcaaaaggctggggtgcagtggtgtgatcctggctcactgaaacctccgcctcctgggttcaagtgattcttgtgcctcagcctcccaaaaagctggaactacagtcatgcaccaccatgcctggctaatttctgtatttttagtagagacggggttttgccacgttggcaaggctggtcttgaacttctggcctcaagtgatccacctgccttggcctcccaaagtgttgagattacaggtgtgagccaccacgcctggcccatgcaggagtattttcaaatctaaaatgcaaacctgcacagctggtggatggtgggagaagttagtagccacaacaggtcaaaacttgaatc

SEQ ID NO: 29262 - DNA, 492 bp, Homo sapiens
gtattactaaagtttatctttagtaaacttatgaaaacactttaaattgtggtttgaaaaaatgcagttgatcccctttaatcatttttaagtgtgtagttcactaatgttaagtctatttgcattgtgcaatagatctctagaacttatttatattgcaaaactgaaactctgtacccattgaacaacaactctcctcattttcccctctcatcaactttgggttgtaacctctattctactttctgtttccgtgattttgagtagtctaggtttctgatataagtggaatcattaaatatttgtccttttgtgactggcttatttcacttagcctaatctcttcaacattcatctgtgttgtggcatgtgtcagcattttcttcgtttttaaggatgaatagtattgcagtgtgtgtgtgtatgtgtgtgtgtgtgtgtgtgtgtgcgctttcacccaggctggagtgctgtggcacaattatggctcac

SEQ ID NO: 29263 - DNA, 378 bp, Homo sapiens
tgtaagggcagctttgtgaaaatataggttgatattactaggtttctacattcataaagcagaaatatgtcatgcatattagaaaaagtgttttagctactaacataaagatataactttctgctttctatcatatattcctgattgtacttcaccaagttcttatgaattgttttcaccatggctccctcactttatttaaaattttaggaccacgaggtaccagatatctacatactaaaatatatatttattcaaaaatgtttccaaaccgtaagaaaagttgtcatttagatactttcagcccatttagtgaatgttgtgcatgttatgttgaaaaaatggagaagatgatgtggttcctgctcttgtactaat

SEQ ID NO: 29264 - DNA, 524 bp, Homo sapiens
gcaacacacaatatgccctgttctctctctcacttaaacttctgtttcttattccctttgctgtgcttcagctacactaaacttcttgctcttcgttatctatcacagttgcttaaacaccccaggcacacctctgtactgggcagttccctgtgtttgggatgccttttcctcagatagcctcctggctttctttttccattccttcagttctttacttcaaagcccctttctcaataaggacttttctggccatcctagaattcccactatccctcctctcaaacctgtaaacatttcattttcctgctttagtttttctcctttaacactgtatattttgcctaatctatctatggttattgtgtttatttcactcccatgagtaggatgtttgtgtgcctagaaaagggcctagcttgcaataagtagctactcaataaatatttattaaatgagcaactgaagtttacccttcggtgtattgttttaaacattagattgattctcaggtaagaaaaaaa

SEQ ID NO: 29265 - DNA, 2583 bp, Homo sapiens
gctacagcttgaagccaaacatttaatgaaagagagcgggaggggccgaatagaagaatgatgggcgtggccaaccccgaggtggctggaggccgcgcccccttcccagagtgcaccgcagccgctgcattcaggaaccgctttagcttcggccccggccggccgggcggggaagactggtgtggtctggccatggatgggctccaggccagtgcagggccgttgaggcgcgggcggccgaggcgccggcgcaagccccagccacacagcgggtcggtcctggccctgcccttgaggtccaggaagatacgaaagcagctgcgaagtgttgtatcccgcatggcagcgctgaggacgcagacgctgcctagcgagaactcggaggaatcgagggtggagtcgacggccgacgacctgggggacgcgctacccggtggggcggcggtggcggccgtcccggacgcagcccggcgagagccatacggccacctggggcccgcagagctgctggaggcctcgcccgccgcgcgctccctgcagaccccgtcggcgcgcctggtgcccgcttccgcgccgcccgcgcgcctggtggaggtgcccgccgcgccggtccgggtggtggagacctcggccctgctgtgcaccgcgcaacacttagcggccgtccagtcgtccggggcccctgcgacggcgtcggggccgcaggtggataacacgggtggggagccggcctgggactccccgctgcggcgcgtcttggccgagctgaaccgcatccccagcagccggcggcgagcggcccgcctctttgagtggctcatcgcgcccatgccgccagatcacttctaccggcgcctatgggagcgcgaggcggtgctggtgcggcggcaggaccacacctactaccagggacttttctctaccgctgacctggattcgatgctgcgcaacgaggaggtgcagttcggccagcatttggacgccgctcgctacatcaacggacgacgcgagaccctgaacccacccggccgcgcgctgcccgccgccgcgtggtccctgtaccaggccggctgctccctgcgtctcctctgtccgcaggctttctctactactgtgtggcagtttttggctgtgcttcaagagcagtttggaagcatggcaggctccaacgtttacctcacgccccctaactcgcagggctttgccccccactacgacgacatcgaggccttcgtgctgcagctggaaggtaggaaactctggcgtgtataccgaccccgagccccaaccgaggaactggctctgacatccagccccaacttcagtcaggacgacctcggtgagccggtgctgcagaccgtgctggaacctggagatttgctgtattttcctcggggcttcattcaccaagctgaatgccaggatggagtccactctctgcacctcaccttgtccacgtaccagcgcaatacctggggtgacttcttagaggccatactgcctctggcagtgcaggctgcaatggaagaaaatgtggagtttcggaggggtctgccccgagacttcatggattacatgggggcccagcattcagattctaaggatccgcgaagaaccgctttcatggagaaggtgcgggtcttggttgcccgcctgggacactttgctcctgttgatgctgtggccgaccagcgagccaaagacttcattcacgattctctgccccctgttttgactgatagggagagggcactaagtgtttacgggcttccaattcgctgggaggctggagaacctgtaaacgtgggggcccagttgacaacagaaacagaagtccatatgcttcaggatgggatagctcggctggtgggtgaggggggccatttgtttctctattacacagtggaaaactcccgtgtgtatcatctggaagaacccaagtgcttggaaatatacccccagcaagctgatgccatggaactgttgcttggttcttatccagagtttgtgagagtgggggacctgccctgtgacagtgtggaggaccagctgtccttggcaaccacgttgtatgataaggggctgctgctcactaagatgcctctagccctaaattagtttcttgttgattgctggaaacaaggcagtagtgattctccgctgccactgctaccttttttttttttttttttccttaaactcacgttcttaccttgataagcatcagtgtgctcacatttacctttatcactgcttcagtgtcacaaacctcggaaggtcttctaggaagaaccatctcatctaggtacaaaaggaaaaggagaagttggaggtggaaaaaaaacccttgatccgtgatcatttcagagcaccaacttcatcaccttcaggcttcagtgtactgggtaacactgaccatgtcgttctgcttgagacagatattagattttttttggaatttggatctttcatctgagttctttttcatgggcgggtcggggtcagtatcctgtttgttattgttaaatttgtatgaaccttagaaaagttattaaagtgccaaagaatgtttccctttcctaa

SEQ ID NO: 29266 - DNA, 496 bp, Homo sapiens
  misc_feature (34)..(34): n is a, c, g, or t
  misc_feature (56)..(56): n is a, c, g, or t
  misc_feature (77)..(77): n is a, c, g, or t
  misc_feature (119)..(119): n is a, c, g, or t
ggggaggaggaggtcaggggcttgcggttgtgtnggagagggagccgagcagtccngtgcacagtgcagggactacnggtgacagtcaggtgttgtgtgtggcgggtgtgctgagagangactccaggtgctcctaccacacacacatacacacacactaacatcgtacacacatacttaccctcatacacacacatacacacacacactcaccctcatacacatacatacatacacacagtctcacacacaattaaaaacacaccttacacacactcatacacacataatcaaacacacacactcatacacatgcatacacactcatacacacacttatccaaacacacccatgcacacacacttatacacacacatacaaaaaggaaccatggaaggtgttggagatattaattgcagccatcatttcagtagtgtacatgtttaccacagcaccatgttgtccaccatgaatatgtacaataaaaataaatgt

SEQ ID NO: 29267 - DNA, 164 bp, Homo sapiens
agagagagagagagagagagagagagagagagagagagagaggtcacttatcccagaagattattttagtgataattttgatgttgaatcaaactaccctgggttgttgactagatgaatgaatgaatgaatagacagcaggcattgccttctgcgatactgca

SEQ ID NO: 29268 - DNA, 1675 bp, Homo sapiens
ggtagaaattcaaaaaagattgaaatgctgctacagaagaaaaagaaaatactgaggtctctgtaatcacagatatttatgttataagaaatcaatacagattaaaaattaggtaagaaaattgatttactaataatcttgatctttagccacatttctctgaaataaatttgctctaatgctgtgacggggatcagcaagctacgttttccaagttccttcaagtgggatcctgctaggttctgctattgggaggtactagagaaacataggcaaaagaatggaagaataggtctccttttcctgtttgtttgctgtccttgccgatattctcccaagaacatccccttgcccaaggagcagtaattgtttcagtttaccaattttttcagagccccagaaagtgcctcttcagaggtaacagcagcagttggaacatatctctccctcagaggtctagcctcagctcaggaaggcttttactctgagttaacaaattttaataactccagtctcttccctttattcatctaagcttctgaggaggtctgtatgtggccaggagatggtggtgatagctgcatcttgcagtaattttctttgctttccacagtgttgttacttttttctccgatttcttatgtggtcaattttttaatattaactcatagtcatagtgtagtattcatgctttatgtgaaatgaaatgttttttataatgtagccatggcctaccaatagcatattttcttttagatttggtgatatatattttgcttcagtgactttatatccttatttgttgcccaaattagttttttgtatacaaaacatccactattaccctggtcccatcatttcttctgttatccattgtcctgtgatttctcctggaaagtgaattgtttatccgtccatttcactctgtgaagtcatacaggtctatctatatagaactcctgtgctccaatttattccctgtgtgaaactgggcaatgtattaatctgggaatatgtttcttcatatgcaaatcagagataacacttacctcacaacattgtttagagcattaaaagaaatataatatgatatcattcacacagaatttccctgggtgtgaattgaacaatgtcaatttttctcccatttaatgtgaaaactaactatataaataaacaaaaaaaacaaaaaaaagaagaaaaaatcaataaaaattattatcaaatgtatacatattaaaatattatcgagtcttatacaaattgagtttttcaaaaataataatgattgtaacttttatattgcagttaatgcaagaagcattatgaaggagaatcacatgtctagagcaaagtgatgttaatagtgtttatgtttgagccagatggaactcctcataggagcacacagtgctcacctcctcccaactttgcattcaaagaaatcatattcataagccaaaattggtcatagaggaaatattcaacaccactaaattaagcaaactaaaaatacagcagtttttctcagtgaactggttgttaaatacatactaaatcaccactaggtggtataggccctcataaatcgcaaaataaaaatgggactgcttagtttctattttgttactttctttatttctgaagagaatgagctcaaattttaacagcagag

SEQ ID NO: 29269 - DNA, 436 bp, Homo sapiens
ttacttactcctgctctacacttgagcctgctcggcactccaggcaggtcttggggctcctatgtaagctgtgttaagctgcagcctaaacacacagcctccccacctcatgatgatgaagaggcagctggggacctgtctacgacagttgacatgaattattatgggaaaataaaatctgttatcaggaaaactaatttagaaacagatgttgggggtacagcccaagttagaaatgaattgcatttatttataaatgattctggtctttagccatttagtattttctttagtgatgatacagatctggatttattcatgtgatagtaaccagaagcatcttcttcctgatgttactattttatggccttcaaaaaagtatttgccttcgttgggcatagtcagagttcctctatcaatacaaattctgatgata

SEQ ID NO: 29270 - DNA, 305 bp, Homo sapiens
cccatcaatatgactttctatactgcttttgaggtcttttgattatcaccttggttaaatgaataacttttattttgcaataacctttgattctggttagaccaagtgttttaaacttttgacatctgtgataagttcccttacggttcaaatcctaaattaagtctttttgaactaaataattatactttttttgtaaattgtatcagaggcattgtcaaatgacaaatgataatagatcttctttcagttagatttatgtgtatgttattgatacaaatattccaaaaattacataaggctgg

SEQ ID NO: 29271 - DNA, 452 bp, Homo sapiens
  misc_feature (1)..(1): n is a, c, g, or t
ngtaatctttcttggtcactgaaacttactagatataggcgagttttatatggaccgtttatggacctttcttatttagaaatctaatgaactaacggttagcttgatagatacgtctggggcatttgcatatcttggtttcccatttctcaggttttaataacagtaaccttgaaaaaagttgatgttcctctggctgtgaaagggctgctgtacctgtttaattattgagttgtgatgataaagcaggctgtatgtgcagttccttgttctttggatgaaaaagtaaactaggggtatagcgtcctagtaatgtaatttttagaaaatattcaactttaggtttccaaaattgggaaatcttggattataaacatttgtctttttttttttctttttttagacggaatctcgctctgtcgcccaggcctggagtgcagtggcgccatctg

SEQ ID NO: 29272 - DNA, 513 bp, Homo sapiens
  misc_feature (476)..(476): n is a, c, g, or t
catctggaaactagttcatttatatttccttctggtctacatgcaatttactcagagatcattttttccatagcggtatagcctactaatgtagtacatactgtaagggctccaagaaacatacctaaaaagttaactaaattcctatgcgagaggtgaaaaggttttgctactattttgccgacagacatggatggtgttccttcctctctatcttgaattacttggcctcacagtacttgagaacattccatttcagtaaaaagttattgcatacctaaataatccaggcaacatgctaggtcaatgtgacttactaagttttgacctttgacatcattctcttacatatttttacataaggaaagagtatttgttttatcttggtgggaacttttattcatccaatgaataatatattaaagaaaacaagtgggaaatttcatgcagaaattacatacaagaaataggaaganaatatacgtcgacgcggccgcgaatttagtagtagta

SEQ ID NO: 29273 - DNA, 1775 bp, Homo sapiens
catctggaaactagttcatttatatttccttctggtctacatgcaatttactcagagatcattttttccatagcggtatagcctactaatgtagtacatactgtaagggctccaagaaacatacctaaaaagttaactaaattcctatgcgagaggtgaaaaggttttgctactattttgccgacagacatggatggtgttccttcctctctatcttgaattacttggcctcacagtacttgagaacattccatttcagtaaaaagttattgcatacctaaataatccaggcaacatgctaggtcaatgtgacttactaagttttgacctttgtatattttcttcctatttcttgtatgtaatttctgcatgaaatttcccacttgttttctttaatatattattcattggatgaataaaagttcccaccaagataaaacaaatactctttccttatgtaaaaatatgtaagagaatgatgtcaaagtttagtctttttattaaaatatagtctccatgagtagactttgtattcttcatcatatatttcctagcacaggcagcattcaataagtatttgctgatgaacaaaaaatggggccgggggtagatggcaaatggaaacctactctggaagcaacattcattctaattcttttcctgaaaaaaaaaaaaaaaaaacaacaaaaaaaagtagcacttgaaagtttttaaactaatcttctaccagaaatggaagtgaaatttcatagtgaggttacccaccaaacaccacaaggagtgagagggctagaagagagaattccagccaagcaagggcacaaaggaaagcaatttggccaagcagtgacatttcctcatttgtttgcctgattatatagagaatcatcttggagagactccaggaagtaaaatacaaaaagatttgggaactctccccagacgtcaaaaaagagcaggcatcctcatcaacaggccatatacatgaagtaggcctctaatactaagatctcctacttttcctttggtgtgagggaaggaaagctttgaaagtgaggctcactcgggggctaacaatcattaaagaatacaaattaccaatttaaactagcctagactttcactgtaagtaggcaaagacaatggaaaatgactaggtgttataaatgacaatcaggagctgtaaaggagaccaagcagtcctcaaaaagagttaagtcaaggcaagaaagcacagaaaactttttaaaaaattctaatcaacaacctcagtgagagttaacagggatttaaaaggatattacattgacaaagcaagagaaactgctacagaaacagcagatgacaagaagagaaactatacagcagaaaaaaaaggaaaaaaatagtagagaagcacacttggaaataaaacacataataatgaaatcaaactcaacagttgagaacagcggaatcaacaacaatgtaaactgaaatgataaactaaaaagagcatattaaagaatttactggccaggcacagtggctcatgcttgtaattccaacactttgggaggctgagattacagatgtgagccaccgtgactgacctattatctgattttagccaacaatgttgtttttcttaatattctttcactgttaattaaatgtgatttaagtaatatcttttaactctcagttgttatagatgaaacagccagcaaaaactcaccctacttcacttcttccataatctttgtcctcctaaattttctattgcatcatttcta

SEQ ID NO: 29274 - DNA, 1655 bp, Homo sapiens
ggaccaccccccaaaaccggggcccgttcccggatgtgaaaaggttttgctactattttgccgacagacatggatggtgttccttcctctctatcttgaattacttggcctcacagtacttgagaacattccatttcagtaaaaagttattgcatacctaaataatccaggcaacatgctaggtcaatgtgacttactaagttttgacctttgtatattttcttcctatttcttgtatgtaatttctgcatgaaatttcccacttgttttctttaatatattattcattggatgaataaaagttcccaccaagataaaacaaatactctttccttatgtaaaaatatgtaagagaatgatgtcaaagtttagtctttttattaaaatatagtctccatgagtagactttgtattcttcatcatatatttcctagcacaggcagcattcaataagtatttgctgatgaacaaaaaatggggccgggggtagatggcaaatggaaacctactctggaagcaacattcattctaattcttttcctgaaaaaaaaaaaaaaaaaacaacaaaaaaaagtagcacttgaaagtttttaaactaatcttctaccagaaatggaagtgaaatttcatagtgaggttacccaccaaacaccacaaggagtgagagggctagaagagagaattccagccaagcaagggcacaaaggaaagcaatttggccaagcagtgacatttcctcatttgtttgcctgattatatagagaatcatcttggagagactccaggaagtaaaatacaaaaagatttgggaactctccccagacgtcaaaaaagagcaggcatcctcatcaacaggccatatacatgaagtaggcctctaatactaagatctcctacttttcctttggtgtgagggaaggaaagctttgaaagtgaggctcactcgggggctaacaatcattaaagaatacaaattaccaatttaaactagcctagactttcactgtaagtaggcaaagacaatggaaaatgactaggtgttataaatgacaatcaggagctgtaaaggagaccaagcagtcctcaaaaagagttaagtcaaggcaagaaagcacagaaaactttttaaaaaattctaatcaacaacctcagtgagagttaacagggatttaaaaggatattacattgacaaagcaagagaaactgctacagaaacagcagatgacaagaagagaaactatacagcagaaaaaaaaggaaaaaaatagtagagaagcacacttggaaataaaacacataataatgaaatcaaactcaacagttgagaacagcggaatcaacaacaatgtaaactgaaatgataaactaaaaagagcatattaaagaatttactggccaggcacagtggctcatgcttgtaattccaacactttgggaggctgagattacagatgtgagccaccgtgactgacctattatctgattttagccaacaatgttgtttttcttaatattctttcactgttaattaaatgtgatttaagtaatatcttttaactctcagttgttatagatgaaacagccagcaaaaactcaccctacttcacttcttccataatctttgtcctcctaaattttctattgcatcatttcta

SEQ ID NO: 29275 - DNA, 246 bp, Homo sapiens
tttttgtatttttagtacaggcaggatttcactatgttggccaggctggtctcgaactcctgacctcaggtgatttgctccccttggtctcccaaagtgctgggattacaggcatgagccactgtgcctggccttattcagttaatttattgagaacctgctgtgtcctagacactattgaccactgtatatgcagtatcactttgtaatatagcttttatacaatcattttaaaaagaaatttag

SEQ ID NO: 29276 - DNA, 554 bp, Homo sapiens
gggtgtgaagggaaagaggctcaaagctaagtactgtagctagtttctggtttctagtataggagagacacttcatagaaatacctcccaaggtgctgggcttataagtgtgagctaccatggtaggccatcatttaaaaaaaaaaaattagtgtttttgtttgggtggcttttttagatgggggctatgttgcctaggctggccttgaactccttgcctgaagccatcctcctgcctcctgagtaactggaaatacaggcgcctgccactgcacccagctcctactcattctttaggtttcagcctggatgttcttttttctgaaaagcattttctgactccgcctacttctcagcctgtatgaggattgcctccatcccccaaatcacacagtagtgtctctctttactgctgcttgtcatccttgtatgtacttactgtggtgctttgaatactctaggcattttaatatttattggagatactcagtaggtagttggtgttctttgactgactttcctctaaagactaaaattcagaatttactgtcagg

SEQ ID NO: 29277 - DNA, 769 bp, Homo sapiens
tgtatgctagagatgatgtctatgtcacaggacagtgacagagatgaaatgattaatgattaaatggctaaatgtcttccaagtgcctggctcatagtaggtatccaaagaaaaggaggcattcatagtaaagatgggtaaatattcatgtgttacagatggaagcaaatgggactcaaagaagttaagacatttgccctaaatcacacagacagttcttaaatggccaagtcagatctggccccagtttgttccccttccactctgccgtggctacctcctgttaatggactatacatttagagtgcttttgcctcataaagtgtgtgaagctccataaatataaaatgtttgtagtcccagccttgctagctcaaatccaagttaaattgactcttgggtagttcttctctcagccccaattctcataagctcaaatatatattttcttagtcccctgggatcctccattctgtgccccaacaatccctaacccttcattagtaatgcctagatgtctccacatatttcaaggggtgccagaaagtctccagacaaaataaaagatgccataaaacactaagtgcataaaactctagacaccttgttctccatgtcatgtttccttttaaaaacaaatattttgaaatgccctctttactatcctgctgatacacacataaaaactaataaaatgcacaaactcttttcttaaaaattgtgggaagatatacataataaaaaatttaccattttaaccactttcaaa

SEQ ID NO: 29278 - DNA, 342 bp, Homo sapiens
agggccaaggggtaagttcacagccttaaatgcctacatcaaaagatctgaaagagcacaaatagacaatctaaggtcacacctcaaggaacttgagtaacaagaacaaaccaaacccaaacccagcagaagaaaagaaataatcaagatcagagcagaactaaataaaactgaaagaaacaaacaacaacaacaaaaaaaaaacaagacaaaagataaatgaaacaaaaagctggttctttgaaaagataaataaaattgatagaccatgagcaacaataaccaggaagagagaagatccaaataagttcaattagaaatgaaacaggagatattgcaacc

SEQ ID NO: 29279 - DNA, 327 bp, Homo sapiens
ttgtgagatccatcccctggcttcattccctgaactggctttagaacactggcagtctagcttataacccccaggctgactagagaactcaaggtaaaagcagcccaagaaaaacagaccaacagaaaagcaatgagagaaaggatgaaggttcccttctcgatgatccattaaatggaagagtaacccaagaaaacatcatggaatccaagaatcagtggatccagcacaacaaagaggcaaagggaattccctaggacagtgtttatggaatcccatgacagtaattatccaacagacctagcgaaccaggccagactggagcag

SEQ ID NO: 29280 - DNA, 317 bp, Homo sapiens
tgaagtctaaccaggaaaaaggaggatgtgcaaaagtatgtttgtgttattattttgtgctttgttttagcttaatacataatttatgtctacccctgtttctgctcttaaaatacactataggaaaatgctatctggacattctttaagcctttctgaaaagtacttgtaacagaagcctttccatttaatggtttaaaaaaaaagtaaatagaatttatggctgtcctgggcccaattaaatttccattcaaacttgtcctgactggaaaataaattgcctatggattctgaataaggggtttgcacacttggag

SEQ ID NO: 29281 - DNA, 943 bp, Homo sapiens
atgtcagatgacgccggtccacgagaaggagggtggattatatccttagagacgccatagagtgaggatataattgctctgtaacaagcataaactgtgatggtctgggatgccctcgtcataggcagcccctggagagtccctcgtcatagacagcccctggagagtcgaaggtccacagaaaacatcctggggtcctgagctgaagtgtgatgggaggagtcctctgtatctcagtctgatcctggtctccctctcggccatggtctcacactagtgctgctgggaaaccatccctcacatccagtcctggcatcgggcagtgactctggtccaactgttgtccaactcaagggtttagctgcttagattttcctaaaacttgaatttcattttcctctagccatggaatacagattaatcctttacaattaaaatccaagttcagattttatttgttgtggtttttaattaaaatctcaccagcactttgtggattttttttttcttagaaaggcaaacacactgtgcgtatcagtcagcctggactgccatcacaaaataccatagactgtgtgtcttaaaacaacagaaatgtattttctcacagttctggaggctggaagttcaaggtcaatgttctggatgatttggtttccagtgaggcctctctttcttgcttgcagatggctgccattcttctgtgtcctgtagggaagttcaaacttttcctctgaaggtttgaacaaactgacaatatgcagactaataggaggaagaaaggcattcaaagttgctaatgtgcataagccaaggccacagaaaatatgagattcaaaggagcaccaggcgcctgaggcttaaataccctcctcataagggagagggaaatggggttgtaggcaattgcgaggggcagtaaatgactttcagtaaacgcatg

SEQ ID NO: 29282 - DNA, 453 bp, Homo sapiens
atgtcagatgacgccggtccacgagaaggagggtggattatatccttagagacgccatagagtgaggatataattgctctgtaacaagcataaactgtgatggtctgggatgccctcgtcataggcagcccctggagagtccctcgtcatagacagcccctggagagtcgaaggtccacagaaaacatcctggggtcctgagctgaagtgtgatgggaggagtcctctgtatctcagtctgatcctggtctccctctcggccatggtctcacactagtgctgctgggaaaccatccctcacatccagtcctggcatcgggcagtgactctggtccaactgttgtccaactcaagggtttagctgcttagattttcctaaaacttgaatttcattttcctctagccatggaatacagattaatcctttacaattaaaatccaagttcagatttt

SEQ ID NO: 29283 - DNA, 993 bp, Homo sapiens
tatcagtaatacgctattttattttcacaaacatctggctcatagataatgtttatcgatgagaaaacagaaatttgaagaggcaaagcaagttgcccaaggccaagggagaaggtcagcgtgaactgctaccgccatgttgaagttcatcttctcttcactgcgagaagctgcctggacaccagggtggaggagctgtcagggccctcactgtggaaggaaggtccacagaaaacatcctggggtcctgagctgaagtgtgatgggaggagtcctctgtatctcagtctgatcctggtctccctctcggccatggtctcacactagtgctgctgggaaaccatccctcacatccagtcctggcatcgggcagtgactctggtccaactgttgtccaactcaagggtttagctgcttagattttcctaaaacttgaatttcattttcctctagccatggaatacagattaatcctttacaattaaaatccaagttcagattttatttgttgtggtttttaattaaaatctcaccagcactttgtggattttttttttcttagaaaggcaaacacactgtgcgtatcagtcagcctggactgccatcacaaaataccatagactgtgtgtcttaaaacaacagaaatgtattttctcacagttctggaggctggaagttcaaggtcaatgttctggatgatttggtttccagtgaggcctctctttcttgcttgcagatggctgccattcttctgtgtcctgtagggaagttcaaacttttcctctgaaggtttgaacaaactgacaatatgcagactaataggaggaagaaaggcattcaaagttgctaatgtgcataagccaaggccacagaaaatatgagattcaaaggagcaccaggcgcctgaggcttaaataccctcctcataagggagagggaaatggggttgtaggcaattgcgaggggcagtaaatgactttcagtaaacgcatg

SEQ ID NO: 29284 - DNA, 503 bp, Homo sapiens
tatcagtaatacgctattttattttcacaaacatctggctcatagataatgtttatcgatgagaaaacagaaatttgaagaggcaaagcaagttgcccaaggccaagggagaaggtcagcgtgaactgctaccgccatgttgaagttcatcttctcttcactgcgagaagctgcctggacaccagggtggaggagctgtcagggccctcactgtggaaggaaggtccacagaaaacatcctggggtcctgagctgaagtgtgatgggaggagtcctctgtatctcagtctgatcctggtctccctctcggccatggtctcacactagtgctgctgggaaaccatccctcacatccagtcctggcatcgggcagtgactctggtccaactgttgtccaactcaagggtttagctgcttagattttcctaaaacttgaatttcattttcctctagccatggaatacagattaatcctttacaattaaaatccaagttcagatttt

SEQ ID NO: 29285 - DNA, 369 bp, Homo sapiens
tttagatagagtctcactctgtcgcccaggctggagtgcattggcaagatctcagctcactgcaacgtccgcctcccgggttcaagaaggtccacagaaaacatcctggggtcctgagctgaagtgtgatgggaggagtcctctgtatctcagtctgatcctggtctccctctcggccatggtctcacactagtgctgctgggaaaccatccctcacatccagtcctggcatcgggcagtgactctggtccaactgttgtccaactcaagggtttagctgcttagattttcctaaaacttgaatttcattttcctctagccatggaatacagattaatcctttacaattaaaatccaagttcagatttt

SEQ ID NO: 29286 - DNA, 382 bp, Homo sapiens
aactgaatttcataaaaggtgtctttctaatgcctttaaatataaaagaaggaagtaggatcgagtacactaaaaagaaaaatagtcatatgatgtaagagtttgtccaccagagcttaacaaaaacagtggagaacagaaaaaaaaatgggctaaatattgaatacaatagcagtttagtaatgatcagaggacagggagatggggggatcatgtctcggcaaaagaaaggtcaaaacaaggcagaaagtacattttgggttaattcaaacaaggtaaagtaatagaagaaaataataccaagtagacattgttttaagataatgaaatgtatagcctaatgttatgcacattgcttagcaacaagcaattaaaaaaaaga

SEQ ID NO: 29287 - DNA, 379 bp, Homo sapiens
cttctcccacgctcctaccttttgtagtctccagtgtctgtttttctattctgtatgtctaagtatttttcatcattgtagcatacaatcaaaaattggtaaaatttaagtgtcaaattcctagttaaaattttttgaaatgatggcatacaaacagctttaaaggtaggccttccgtcccattttttttttttggtaagatttatgaatagattgaaaaatataaaaattcggtggaaatcagaagctaagtcttatctttagtagtcagcttcctttctatgaatttgagttttattgagtcttcttcatcacaagagatcatgaatttggtaataaatctagaaaagtgcagctttttgttagtatatgtaaataa

SEQ ID NO: 29288 - DNA, 3637 bp, Homo sapiens
tctgttatcctaaatactttattatttcagaaatgcttttatttcttattttttttcagtcatcattgttacctaattcaagtgagtaccttctccatgccaggtcttgtgtttacatggttaaaacatggttcctgccctcaaggagtttacagcatacagagggatataataaaaacagacagataaggaattagaagggattggtgctaagacagggacaaacacaaaatgctctagaagcacagaataggggaacctacccaatttgaggaggtggaggaaggacaggaaaatcctgtcacagaaaatagcttctaagctgagatctgatgaagtagaagaatttattcaggtaaaggggttagatcgggaaaggggtcttctgggtagaaagaactatgtaaagtgattcagagttattacattctgcaaactgggaataattcacagtaactgtagtaagcatccaaggggcaaggccaagctgggtgtagtggcaggtgcctgtaatcccagttactcaagaggctgagacaggagaatcgcttgaatccgggaggcggaggttgcagtgggccgagttagcaccattgcactccagcctgggcgacagagtgagactccgtctcaaaaaataataaatgaagtaacaatggtgaagtttgaagtaactcaggtgaagtaacacctaagtggaaattccatactccactcagtaaaccattatcatgggctagttgaattgtaagacactttattatgttgctacaatatttcaggtgagagatgattaggaaccaaggaaggtaatgacaatgggtataaagaagagtagacagggctgggcatggtggctcacgcctgtaatcccagcactttgggagaccgagatgggggggatcacctgaggttgggaattcaagaccagcctggccaacatggtgaaaccccatctctaccaaaaatagtaaaaattaaccgggcgtggtggcgggtgcctgtaatcccagctactcaggaggctgagacaggagaatcacttaacccaggaggtggaggttgcagtgagccaagatcgcaccattgcactccagcctgggcgacaagagcaagactccatctcaagaaaaaactcaaacaccaaatacaaaagaaaaaggactggagtatccatttgatttggcagttagtaacctttttgagaccaatttcagtggatttgtagaggtgaaatctggcttatagaactaagtaatatggagaggttttgtggttgttttaggatgggaataattcaggcatatttattgaaagagtgaaaggaataagtaaaagctggagctcagtagagaatgataataaccaaaaagcagggttctgaagagaaaggaggtgaaatgagcacaggtggatgtggtttagttacatggtctacttctgcagacgtttgctgagcacttaccgtgtgccagccactctactaggtggtggggttagtctacttgggaagccaactgagtgagaaagtggtctcaagtaggactatatatgcctcatcctgctggagactcaaggcgaaaatataacagtaaactcccagctgattgtttttgactggggctaagtaatttataggagtcgttgtctgacagctttagtcagacttgtaaagtaggatgttagagaggtgggagtgtaaaaagtatagccataaaaggacatagaagagaggaggggcggagcccaatgactcaggcgcctataatcccgacagtttgggaggctgaggcaggaggattgcttgagtccaggagttccagaccagcctggacaacatggtaagaactcatctgtacaaaaaataaaagccaggcatggtggcacacgcctatagtcccagctacttgggacggtgaggtaggaagatctcgagcccaggacgagactgcagtgcacaattatcgtgcttgtgactagccactgcactccagcctgggcaacataaccaaaccccatctcttaaaaaaggtggggaggggtggttaggaagcaagcaatgttgaggttctaacagattggtaccatgaacatgtaatggtaccaatccatatctttgtgctattttctctagaagcacctagctccctgggtacaagagcagggacgacattattgtttagatcctgagtcaggatttgtagacagataaagtatactaagaaggaagcaaggggatgaaagtgctggtgaaagattaaagaatctctctgattatagctagataagaaaataggctaaggaagttgtgataaagctggtctcgaactcctgatctcaggtgatccacccaccttggcctcccaaagtgttgggattacaggcgtgagccaccatgcccggcccccctcaaatggttttatctgtcacactggtgctcctgcaatggacaaaggagacgtttcctgtaggaccagcatctctttactcaggtttttcaatcttggaactgctgacattttgggccaagtaattctttgttgcagggactgtcctgtgcatttcaggatgtttaacagcatctttgtcctctacccattagttgcttagtcagaataatcagaaaagtccccagacattgccaaatgccccctggagttgcctggttgcctggttgagaatcactatgcttaagaaaggggctcttgttgtaatcccagcactttgggaggccgaggcgggaggatcacgaggtcaggagatcgagaccatcctggttaacacagtgaaaccccatctctactaaaaatacaaaaattagctgggcatggtggcatgcgtctgtagtcccagctactcgggaggctgaggcaggagaatggcatgaaccccgggaggtggagcttgcagtgagccgagatcgcgccactgcactccagcctgcgtgacagagagaggctccatttcaaaaaaaaaaaaaaaaaaagcggggatggggggctgttttaactcaggtctgggcccacttagtcctcatggcagtatctattcttattcctgcatctccatgcctagctgcctttttctcacctttctttctggggctaccacacctttatcagatgagatcctccaacctctctctaccctcagtatctccaaaagtgccacctgggttgaaaatgagaagcaaaagcatctacccttccccctcttgcaccaagggtataccctaattagataggaatttacataattggtaaaaataagatatcatgggctggccacagtggctcacacctgtaatgccagcattttgagaggccgaggcacgaggaattcttcagcccaggagtttgagaccaggctgggcgatgtagtgagaccttgtctctacaaaaaaattaaaaattaactgagtggtggcaggcgcctgtagtcccagctactcgggaggctgaggcaagagaattgcttgaacttcggaggaagaggtttaagtaagcaaagattacaccaccgcactccagcctgggtgacagagccagactctgtctccaaaacaaaagacaaagtgcatacaaggctcagctcttaacaatgactgcttggataacagacgactaattggaggtcc

SEQ ID NO: 29289 - DNA, 3575 bp, Homo sapiens
tctgttatcctaaatactttattatttcagaaatgcttttatttcttattttttttcagtcatcattgttacctaattcaagtgagtaccttctccatgccaggtcttgtgtttacatggttaaaacatggttcctgccctcaaggagtttacagcatacagagggatataataaaaacagacagataaggaattagaagggattggtgctaagacagggacaaacacaaaatgctctagaagcacagaataggggaacctacccaatttgaggaggtggaggaaggacaggaaaatcctgtcacagaaaatagcttctaagctgagatctgatgaagtagaagaatttattcaggtaaaggggttagatcgggaaaggggtcttctgggtagaaagaactatgtaaagtgattcagagttattacattctgcaaactgggaataattcacagtaactgtagtaagcatccaaggggcaaggccaagctgggtgtagtggcaggtgcctgtaatcccagttactcaagaggctgagacaggagaatcgcttgaatccgggaggcggaggttgcagtgggccgagttagcaccattgcactccagcctgggcgacagagtgagactccgtctcaaaaaataataaatgaagtaacaatggtgaagtttgaagtaactcaggtgaagtaacacctaagtggaaattccatactccactcagtaaaccattatcatgggctagttgaattgtaagacactttattatgttgctacaatatttcaggtgagagatgattaggaaccaaggaaggtaatgacaatgggtataaagaagagtagacagggctgggcatggtggctcacgcctgtaatcccagcactttgggagaccccatctctaccaaaaatagtaaaaattaaccgggcgtggtggcgggtgcctgtaatcccagctactcaggaggctgagacaggagaatcacttaacccaggaggtggaggttgcagtgagccaagatcgcaccattgcactccagcctgggcgacaagagcaagactccatctcaagaaaaaactcaaacaccaaatacaaaagaaaaaggactggagtatccatttgatttggcagttagtaacctttttgagaccaatttcagtggatttgtagaggtgaaatctggcttatagaactaagtaatatggagaggttttgtggttgttttaggatgggaataattcaggcatatttattgaaagagtgaaaggaataagtaaaagctggagctcagtagagaatgataataaccaaaaagcagggttctgaagagaaaggaggtgaaatgagcacaggtggatgtggtttagttacatggtctacttctgcagacgtttgctgagcacttaccgtgtgccagccactctactaggtggtggggttagtctacttgggaagccaactgagtgagaaagtggtctcaagtaggactatatatgcctcatcctgctggagactcaaggcgaaaatataacagtaaactcccagctgattgtttttgactggggctaagtaatttataggagtcgttgtctgacagctttagtcagacttgtaaagtaggatgttagagaggtgggagtgtaaaaagtatagccataaaaggacatagaagagaggaggggcggagcccaatgactcaggcgcctataatcccgacagtttgggaggctgaggcaggaggattgcttgagtccaggagttccagaccagcctggacaacatggtaagaactcatctgtacaaaaaataaaagccaggcatggtggcacacgcctatagtcccagctacttgggacggtgaggtaggaagatctcgagcccaggacgagactgcagtgcacaattatcgtgcttgtgactagccactgcactccagcctgggcaacataaccaaaccccatctcttaaaaaaggtggggaggggtggttaggaagcaagcaatgttgaggttctaacagattggtaccatgaacatgtaatggtaccaatccatatctttgtgctattttctctagaagcacctagctccctgggtacaagagcagggacgacattattgtttagatcctgagtcaggatttgtagacagataaagtatactaagaaggaagcaaggggatgaaagtgctggtgaaagattaaagaatctctctgattatagctagataagaaaataggctaaggaagttgtgataaagctggtctcgaactcctgatctcaggtgatccacccaccttggcctcccaaagtgttgggattacaggcgtgagccaccatgcccggcccccctcaaatggttttatctgtcacactggtgctcctgcaatggacaaaggagacgtttcctgtaggaccagcatctctttactcaggtttttcaatcttggaactgctgacattttgggccaagtaattctttgttgcagggactgtcctgtgcatttcaggatgtttaacagcatctttgtcctctacccattagttgcttagtcagaataatcagaaaagtccccagacattgccaaatgccccctggagttgcctggttgcctggttgagaatcactatgcttaagaaaggggctcttgttgtaatcccagcactttgggaggccgaggcgggaggatcacgaggtcaggagatcgagaccatcctggttaacacagtgaaaccccatctctactaaaaatacaaaaattagctgggcatggtggcatgcgtctgtagtcccagctactcgggaggctgaggcaggagaatggcatgaaccccgggaggtggagcttgcagtgagccgagatcgcgccactgcactccagcctgcgtgacagagagaggctccatttcaaaaaaaaaaaaaaaaaaagcggggatggggggctgttttaactcaggtctgggcccacttagtcctcatggcagtatctattcttattcctgcatctccatgcctagctgcctttttctcacctttctttctggggctaccacacctttatcagatgagatcctccaacctctctctaccctcagtatctccaaaagtgccacctgggttgaaaatgagaagcaaaagcatctacccttccccctcttgcaccaagggtataccctaattagataggaatttacataattggtaaaaataagatatcatgggctggccacagtggctcacacctgtaatgccagcattttgagaggccgaggcacgaggaattcttcagcccaggagtttgagaccaggctgggcgatgtagtgagaccttgtctctacaaaaaaattaaaaattaactgagtggtggcaggcgcctgtagtcccagctactcgggaggctgaggcaagagaattgcttgaacttcggaggaagaggtttaagtaagcaaagattacaccaccgcactccagcctgggtgacagagccagactctgtctccaaaacaaaagacaaagtgcatacaaggctcagctcttaacaatgactgcttggataacagacgactaattggaggtcc

SEQ ID NO: 29290 - DNA, 2511 bp, Homo sapiens
tctgttatcctaaatactttattatttcagaaatgcttttatttcttattttttttcagtcatcattgttacctaattcaagtgagtaccttctccatgccaggtcttgtgtttacatggttaaaacatggttcctgccctcaaggagtttacagcatacagagggatataataaaaacagacagataaggaattagaagggattggtgctaagacagggacaaacacaaaatgctctagaagcacagaataggggaacctacccaatttgaggaggtggaggaaggacaggaaaatcctgtcacagaaaatagcttctaagctgagatctgatgaagtagaagaatttattcaggtaaaggggttagatcgggaaaggggtcttctgggtagaaagaactatgtaaagtgattcagagttattacattctgcaaactgggaataattcacagtaactgtagtaagcatccaaggggcaaggccaagctgggtgtagtggcaggtgcctgtaatcccagttactcaagaggctgagacaggagaatcgcttgaatccgggaggcggaggttgcagtgggccgagttagcaccattgcactccagcctgggcgacagagtgagactccgtctcaaaaaataataaatgaagtaacaatggtgaagtttgaagtaactcaggtgaagtaacacctaagtggaaattccatactccactcagtaaaccattatcatgggctagttgaattgtaagacactttattatgttgctacaatatttcaggtgagagatgattaggaaccaaggaaggtaatgacaatgggtataaagaagagtagacagggctgggcatggtggctcacgcctgtaatcccagcactttgggagaccgagatgggggggatcacctgaggttgggaattcaagaccagcctggccaacatggtgaaaccccatctctaccaaaaatagtaaaaattaaccgggcgtggtggcgggtgcctgtaatcccagctactcaggaggctgagacaggagaatcacttaacccaggaggtggaggttgcagtgagccaagatcgcaccattgcactccagcctgggcgacaagagcaagactccatctcaagaaaaaactcaaacaccaaatacaaaagaaaaaggactggagtatccatttgatttggcagttagtaacctttttgagaccaatttcagtggatttgtagaggtgaaatctggcttatagaactaagtaatatggagaggttttgtggttgttttaggatgggaataattcaggcatatttattgaaagagtgaaaggaataagtaaaagctggagctcagtagagaatgataataaccaaaaagcagggttctgaagagaaaggaggtgaaatgagcacaggtggatgtggtttagttacatggtctacttctgcagacgtttgctgagcacttaccgtgtgccagccactctactaggtggtggggttagtctacttgggaagccaactgagtgagaaagtggtctcaagtaggactatatatgcctcatcctgctggagactcaaggcgaaaatataacagtaaactcccagctgattgtttttgactggggctaagtaatttataggagtcgttgtctgacagctttagtcagacttgtaaagtaggatgttagagaggtgggagtgtaaaaagtatagccataaaaggacatagaagagaggaggggcggagcccaatgactcaggcgcctataatcccgacagtttgggaggctgaggcaggaggattgcttgagtccaggagttccagaccagcctggacaacatggtaagaactcatctgtacaaaaaataaaagccaggcatggtggcacacgcctatagtcccagctacttgggacggtgaggtaggaagatctcgagcccaggacgagactgcagtgcacaattatcgtgcttgtgactagccactgcactccagcctgggcaacataaccaaaccccatctcttaaaaaaggtggggaggggtggttaggaagcaagcaatgttgaggttctaacagattggtaccatgaacatgtaatggtaccaatccatatctttgtgctattttctctagaagcacctagctccctgggtacaagagcagggacgacattattgtttagatcctgagtcaggatttgtagacagataaagtatactaagaaggaagcaaggggatgaaagtgctggtgaaagattaaagaatctctctgattatagctagataagaaaataggctaaggaagttgtgataaactggtcaagccaggcgcggtggcccacacctgtaatcctagcactttgggaggctggggtgggtggatcatgaggtcaggtcaggagtttgagaccagcctggccaacatagtgaaactccgtctctactaaaaatacaaaaaattagctgggtgtggtggcgtgcgcctgtaatcccagctaccagggaggctg

SEQ ID NO: 29291 - DNA, 2238 bp, Homo sapiens
tcaataaataaaataaagtagcatcaaattgatacatatcctagagtagttatctttttttcctctgagctccaacaagaaacaacagtatttacatttttaactggagacaaaactctgcataggagaaattcaaacatcagcagacatatgagggcgttttttggcagaggcaacttactgtcaataaagtctcacccctggtgaacgccacctgctcacacgtacaaaaggaaagtcatttagtgatcatgaatcctggtttgacgttaaggtccatgtctgaagtgtcgtttatgattagggaagtctgagtcatccttaggcttcctctattgcatttgagtcatttccttttttacagacccaaactgtacagcccaggatatttcttaaatgtccaaaagtacagagttttggaactaaagggacattcgagatcattgagttcagtgtactcgttttacaaatggtgaaactaaggccaagaggagcatgcctttgcctgattgcacagcctctgtggggcagttttgcctataccaagaagggtataggaaaataccctattctctagaaccagctgatttcacagcaaatttggattctggcttgaatttatttttgtcagaagtaaactaaaaatacttggtctgaaagtctgagagggactcagggcccaggggaacaagcaggcatctctggtatatccccctcaaatagttttttgtttgtttgttttagacagagtgttgctcttgtttcccaggctggagagcaatggcgcaatctcggctcactgcaacctccacctcctagattcaagcgattctcctgccgcagcctcccaggtagccatcacacccagctaattttttgtatttttagtagagatggggtttcatcatgttggccaggctggtctcgaactcctgatctcaggtgatccacccaccttggcctcccaaagtgttgggattacaggcgtgagccaccatgcccggcccccctcaaatggttttatctgtcacactggtgctcctgcaatggacaaaggagacgtttcctgtaggaccagcatctctttactcaggtttttcaatcttggaactgctgacattttgggccaagtaattctttgttgcagggactgtcctgtgcatttcaggatgtttaacagcatctttgtcctctacccattagttgcttagtcagaataatcagaaaagtccccagacattgccaaatgccccctggagttgcctggttgcctggttgagaatcactatgcttaagaaaggggctcttgttgtaatcccagcactttgggaggccgaggcgggaggatcacgaggtcaggagatcgagaccatcctggttaacacagtgaaaccccatctctactaaaaatacaaaaattagctgggcatggtggcatgcgtctgtagtcccagctactcgggaggctgaggcaggagaatggcatgaaccccgggaggtggagcttgcagtgagccgagatcgcgccactgcactccagcctgcgtgacagagagaggctccatttcaaaaaaaaaaaaaaaaaaagcggggatggggggctgttttaactcaggtctgggcccacttagtcctcatggcagtatctattcttattcctgcatctccatgcctagctgcctttttctcacctttctttctggggctaccacacctttatcagatgagatcctccaacctctctctaccctcagtatctccaaaagtgccacctgggttgaaaatgagaagcaaaagcatctacccttccccctcttgcaccaagggtataccctaattagataggaatttacataattggtaaaaataagatatcatgggctggccacagtggctcacacctgtaatgccagcattttgagaggccgaggcacgaggaattcttcagcccaggagtttgagaccaggctgggcgatgtagtgagaccttgtctctacaaaaaaattaaaaattaactgagtggtggcaggcgcctgtagtcccagctactcgggaggctgaggcaagagaattgcttgaacttcggaggaagaggtttaagtaagcaaagattacaccaccgcactccagcctgggtgacagagccagactctgtctccaaaacaaaagacaaagtgcatacaaggctcagctcttaacaatgactgcttggataacagacgactaattggaggtcc

SEQ ID NO: 29292 - DNA, 709 bp, Homo sapiens
ttaaggcaccttcccgacttttccagagacctccccgattttgacagagaagcaggccaaacagctcctaagatctcggcgacaggatagaccaagcaaacccggattccccgatgagccaatgcgggaatacatgcaccacctgctcgccctggagcatcgcgctgaggagcagttcctggagcactggctgaaccctcactgcaaaccccactgtgacaggaacaggattcatcctgtgtaaggggatcaggaccagcctcgcaagcattttaatagacaacaagctggataatgtcgaagcaagacaaggctgcttctttcacttgtttttaaattgcagaaatggatgtcttcagacctcgtgaactgtgggcatatcaaagattgccttggaaatggcaaatatatatactgcttcattttactaacctgcatagatcactaaaaccaatagcttaaagcatagacacctcccaaaggtcttcccatcagtttgcaagagtgggaacaaccagaatcttacctggggttgatggagctggaactcccagaccaggagttggggcaggctgcctgccctaaggaatttggggaatccttgttcagagtagtgaagcataccacttggggttgctgagttgttttgtcctctatttttttcctcttcttttctgccctaataaacattggtattaaatttaaatta

SEQ ID NO: 29293 - DNA, 1310 bp, Homo sapiens
atgatgggacaaaatcaaaccagcatctcagacttcctgctcctgggcctgcccatccaaccagagcagcaaaacctgtgctatgccctgttcttggccatgtatcttaccaccctcctggggaacctcctcatcattgtcctcattcgactggattcccatctccacacgcctatgtatttgtttctcagcaacttgtccttctctgacctctgcttctcttccgtgaccattcccaagttgttacagaacatgcagaaccaggacccatccatcccctatgcggactgcctgacccaaatgtacttcttcctgttatttggagacctggagagcttcctccttgtggccatggcctatgaccgctatgtggccatctgcttccccctgcactacaccgccatcatgagccccatgctctgtctcaccctggtggcgctgtcctgggtgctgaccaccttccatgccatgttacacactttactcatggccaggttgtgtttttgtgcagacaatgtgatcccccactttttctgtgatatgtctgctctgctgaagctggccttctctgacactcgagttaatgaatgggtgatatttatcatgggagggctcattcttgtcatcccattcctactcatccttgggtcctatgcaagaattgtctcctccatcctcaaggtcccttcttctaagggtatctgcaaggccttctctacttgtggctcccacctgtctgtggtgtcactgttctatggaaccgttattggtctctacttatgctcatcagctaatagttctactctaaaggacactgtcatggctatgatgtacactgtggtgacccccatgctgaaccccttcatctacagcctgaggaacagagacatgaagggagccctgagcagagtcattcatcagaagaaaactttcttctctctctgatgataacacttggagctattacatagtttatccagtaaaatattgatattaatattggaatattattctaaattatttcctcaccatccttttgttgaaatggcatcgtacataatttttcaatatgtagtggagatgaagcatagctgagtagttgaactagggaagagggtcttggtgacctggctaagacttcctgtttgtcttcccaaggtgatcttggaaaaatgtagtttaagaacaactgttttaaatggtcttcatgccccacattcttaaattatcacaggattttgttatgttactcagaattttgctttgattgtagaatcatttttgtttaattaaaaaaatttttaaatttt

SEQ ID NO: 29294 - DNA, 230 bp, Homo sapiens
tgtgaatagtgaataattagtacttactacttcccagccaccgtgctacgtgtttactgtgaatcaacacctttagccacattttaggattttgggaaaggagggacaaagataataaggaatctggccaagttcccaactaagaagtggtagagctaggattggaagctaagcagtcgggctctggagctgaggctcttaagtcaccgcattattttgctgcattttca

SEQ ID NO: 29295 - DNA, 366 bp, Homo sapiens
gaaaaatgaagccccttcacacattcatagagaagtgtgcttgaaaagagagaagaagcagcagagagtgcttagcagcaaggctatttactacttctgtatcctaggcagttttccaggctgtagtttcacccccaaccttgcctcccctgctgaatgtggctggtgccaaattcctgctattggctgagtcatcatgtcctagttgatctggcaccgtagtcaacatttgtagcttttaccattgttgctttggagctagatcactaggttagattataggctagataattaggttttcctaaatagagaatctgctggtgctgaaacttgccccagaaggcacaccgtggtggttattcacgt

SEQ ID NO: 29296 - DNA, 294 bp, Homo sapiens
gaattagaacccatgtagtcaaccattatctttactgtgagattaaacacattttggaaagatgggctaggaaatattttgttgacaatagtggctaattatactatgagagtcagaagaaactgtgcaaaggtatctttacgaaccatttaatcaaattgttttaaaaaacctttcccaatacacatcatagatgtagagtagatactagacatattagtaatctttgatagtcatgtagtcagcatctgattcacaatttctaatattttaccatttcctgcagtgaagagg

SEQ ID NO: 29297 - DNA, 309 bp, Homo sapiens
cagagaaatgaaagcaggagccttgaatctagatttttccagaatccttttgagagacttattgtagcggcaggagctccattttgggggggtcaccccctgaactttgatggttttcaaatctttggagggccttggtcttagtggctcagaggtcccctgccaggacttctttaggatggggatgataggaagcgaacgttccttctgttgaggtgcatcagccttgcatctgagttcttgatgtcctcaggcctggcttcccagttggttaaaggaatgaaaataacaacgcctttcatttgcagt

SEQ ID NO: 29298 - DNA, 334 bp, Homo sapiens
ggaagttatgggaggaaaatgaaataattactaattaataattactattaataaggtttcaaatgatccccttttttccccttgcctgggtgtccttccatcatgtccaagtcttagatcagtttctagatctaggctcaacaaaattccctcccctggacccccaagccttcccagatagtcaccttcctcttccatatgtccatggcacctagtttgaaatgttcttacctcatgcatcatgttctgccttgtgttagaccctttaagcttttgtgtctcattaagatattgaactcggctgcgtgcggtggctcacgcctataatcccagc

SEQ ID NO: 29299 - DNA, 1129 bp, Homo sapiens
actgttctcgcgttcgcggacggctgtggtgttttggcgcatgggcggagccgtagttacggtcgactggggcgtcgtccctagcccgggagccgggtctctggagtcgcggcccggggttcacgatgtccgacgaggaagcgaggcagagcggaggctcctcgcaggccggcgccgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcgggtctgcaagtggatgatgagattgtggagttcggctctgtgaacacccagaacttccagtcactgcataacattggcagtgtggtgcagcacagtgaggggaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctggcaggtactggtgtgattattattattatttttaataaagagttttacagtgctgatatg

SEQ ID NO: 29300 - DNA, 2349 bp, Homo sapiens
actgttctcgcgttcgcggacggctgtggtgttttggcgcatgggcggagccgtagttacggtcgactggggcgtcgtccctagcccgggagccgggtctctggagtcgcggcccggggttcacgatgtccgacgaggaagcgaggcagagcggaggctcctcgcaggccggcgccgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcgggtctgcaagtggatgatgagattgtggagttcggctctgtgaacacccagaacttccagtcactgcataacattggcagtgtggtgcagcacagtgaggggaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctggcaggtactggtgtgattattattattatttttaataaagagttttacagtgctgatatgaccctgttgtcaccccagctgaatttcttatgaccctcccaaaccaaagctcagatggggtcagaagagcttcatagaaagttgggcaaaacaggctagcaattgcaaagtcaggctttgaccaacatatttctttgcactgaggccttgctgctgtggatacggaaatggttaagtactgtgcttcctcagcagctgggctgtcagggccatagtagctccctttggagaacagggaaagcctggaggcttcccaggtggcccagcgtggtgtcctgtcagcttcctctttaggaacccaccagagggcagcaagctcctttcacttcgctagtaagaacccctccgtttttgtgtgtttttgtttttgttttctggagacaaggtcttgctttgtcacccaggctggagtgcagtgtcgtgatcaaggttcactgaagccttgacgctgtgggcactgcctcagccgcccaagtatctgggaccacaggcgtgcaccaccatgcatagctaatttattttttgtagagacagggtctccctgtgttgaccaggttggtctcgaactcctgggctcaagcagtcctcctgccttggcctcctaaagtgctgggatcacaggcgtgagccactgcgcccagcccactgctagtttgactttttataattgaacctcctggctatgccctgagatcagcgctattttgtaaaccgctgaggtatggataggaacgagtagatcagacctcttgaaaatgcttattcttcctcccttttattttttgtctcttttaagatggtaaaatggttctcagggattcctgccaatactttgaattattttttcctctccatggtatcagtgttcatttccccagttcttgcacaccgctttctgttttggcagttctgccaggcaagccctgtgttccttgggactggttttgctgtggttggatacagataccagcttgccttgatgggattggtattgctgtgtgcttccagccacaggttctcacactcaattccaaagccttcctattgggcgaattccctcaaactctatttgacctgacagccatacgtattcccctctggtagccacagacatgctgtgtttaccaatgtttgctgtttaaattgcatgttctaattccacgtattttccagtctcttttataaagtctcagactataataaacacagcttgcccagtt

SEQ ID NO: 29301 - DNA, 1194 bp, Homo sapiens
actgttctcgcgttcgcggacggctgtggtgttttggcgcatgggcggagccgtagttacggtcgactggggcgtcgtccctagcccgggagccgggtctctggagtcgcggcccggggttcacgatgtccgacgaggaagcgaggcagagcggaggctcctcgcaggccggcgccgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcgggtctgcaagtggatgatgagattgtggagttcggctctgtgaacacccagaacttccagtcactgcataacattggcagtgtggtgcagcacagtgagggggccctggcacccaccatcctactttctgtctctatgaatttgactactccagggacctcatctagaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctggcaggtactggtgtgattattattattatttttaataaagagttttacagtgctgatatg

SEQ ID NO: 29302 - DNA, 988 bp, Homo sapiens
actgttctcgcgttcgcggacggctgtggtgttttggcgcatgggcggagccgtagttacggtcgactggggcgtcgtccctagcccgggagccgggtctctggagtcgcggcccggggttcacgatgtccgacgaggaagcgaggcagagcggaggctcctcgcaggccggcgccgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcgggtctgcaagtggatgatgagattgtggagttcggctctgtgaacacccagaacttccagtcactgcataacattggcagtgtggtgcagcacagtgaggggaagcccctgaatgtgacagtgatccgcaggggggaaaaacaccagcttagacttgttccaacacgctgggcaggaaaaggactgctgggtgaatattctctgaagatgtgtcctgggacagtaaggaggcatctctgcctgattggttagagttcatggtttctccgagatagttgaaggtgaccgaattgtgtgggatgtggcgcaaggttcggagggctaaaggggttaaggcggaagaaggggggggggatgggggtattaaaggggaaaaaggaggagctatgatagtttaggtatgtattgga

SEQ ID NO: 29303 - DNA, 2783 bp, Homo sapiens
actgttctcgcgttcgcggacggctgtggtgttttggcgcatgggcggagccgtagttacggtcgactggggcgtcgtccctagcccgggagccgggtctctggagtcgcggcccggggttcacgatgtccgacgaggaagcgaggcagagcggaggctcctcgcaggccggcgccgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcgggtctgcaagtggatgatgagattgtggagttcggctctgtgaacacccagaacttccagtcactgcataacattggcagtgtggtgcagcacagtgaggggaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctggcaggtactggtgtgattattattattatttttaataaagagttttacagtgctgatatgaccctgttgtcaccccagctgaatttcttatgaccctcccaaaccaaagctcagatggggtcagaagagcttcatagaaagttgggcaaaacaggctagcaattgcaaagtcaggctttgaccaacatatttctttgcactgaggccttgctgctgtggatacggaaatggttaagtactgtgcttcctcagcagctgggctgtcagggccatagtagctccctttggagaacagggaaagcctggaggcttcccaggtggcccagcgtggtgtcctgtcagcttcctctttaggaacccaccagagggcagcaagctcctttcacttcgctagtaagaacccctccgtttttgtgtgtttttgtttttgttttctggagacaaggtcttgctttgtcacccaggctggagtgcagtgtcgtgatcaaggttcactgaagccttgacgctgtgggcactgcctcagccgcccaagtatctgggaccacaggcgtgcaccaccatgcatagctaatttattttttgtagagacagggtctccctgtgttgaccaggttggtctcgaactcctgggctcaagcagtcctcctgccttggcctcctaaagtgctgggatcacaggcgtgagccactgcgcccagcccactgctagtttgactttttataattgaacctcctggctatgccctgagatcagcgctattttgtaaaccgctgaggtatggataggaacgagtagatcagacctcttgaaaatgcttattcttcctcccttttattttttgtctcttttaagatggtaaaatggttctcagggattcctgccaatactttgaattattttttcctctccatggtatcagtgttcatttccccagttcttgcacaccgctttctgttttggcagttctgccaggcaagccctgtgttccttgggactggttttgctgtggttggatacagataccagcttgccttgatgggattggtattgctgtgtgcttccagccacaggttctcacactcaattccaaagccttcctattgggcgaattccctcaaactctatttgacctgacagccatacgtattcccctctggtagccacagacatgctgtgtttaccaatgtttgctgtttaaattgcatgttctaattccacgtattttccagtctcttttataaagtctcagactataataaacacagcttgcccagtttatcctttcttttttattttaagatgtatgcatattaatcaatttaccatcactggggcatggcagtgtgggcggggagaattattcacattctcctaaaatgacagcagcagagagccttctgcctcagtggctctggctggtttcctgcaggggtcccagtggaaacccgtgtggccacctgttgccgtcttccatgagatgttagtggagagccactttgacgtggaatgatcctaatagatatagccagaccggttttgcggaaacgctttgtgctgagaaccgcaagctggtgcaccctgtgtcatatctgcccccagccagctggaattgtctgcaacacgcggtgcccggtgaggaggcaggcaggacggttgtgtgctgcatccatgagacctggaaattcagtttgcttttggaaaagagcattg

SEQ ID NO: 29304 - DNA, 917 bp, Homo sapiens
actgttctcgcgttcgcggacggctgtggtgttttggcgcatgggcggagccgtagttacggtcgactggggcgtcgtccctagcccgggagccgggtctctggagtcgcggcccggggttcacgatgtccgacgaggaagcgaggcagagcggaggctcctcgcaggccggcgccgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatggtctgcaagtggatgatgagattgtggagttcggctctgtgaacacccagaacttccagtcactgcataacattggcagtgtggtgcagcacagtgaggggaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctggcaggtactggtgtgattattattattatttttaataaagagttttacagtgctgatatg

SEQ ID NO: 29305 - DNA, 2288 bp, Homo sapiens
ccacgcgtcgctttggcgaaggccctccacgggccttcgccaaagtgaacagcatcagccccggctccccagccagcatcgcgggtctgcaagtggatgatgagattgtggagttcggctctgtgaacacccagaacttccagtcactgcataacattggcagtgtggtgcagcacagtgaggggaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctggcaggtactggtgtgattattattattatttttaataaagagttttacagtgctgatatgaccctgttgtcaccccagctgaatttcttatgaccctcccaaaccaaagctcagatggggtcagaagagcttcatagaaagttgggcaaaacaggctagcaattgcaaagtcaggctttgaccaacatatttctttgcactgaggccttgctgctgtggatacggaaatggttaagtactgtgcttcctcagcagctgggctgtcagggccatagtagctccctttggagaacagggaaagcctggaggcttcccaggtggcccagcgtggtgtcctgtcagcttcctctttaggaacccaccagagggcagcaagctcctttcacttcgctagtaagaacccctccgtttttgtgtgtttttgtttttgttttctggagacaaggtcttgctttgtcacccaggctggagtgcagtgtcgtgatcaaggttcactgaagccttgacgctgtgggcactgcctcagccgcccaagtatctgggaccacaggcgtgcaccaccatgcatagctaatttattttttgtagagacagggtctccctgtgttgaccaggttggtctcgaactcctgggctcaagcagtcctcctgccttggcctcctaaagtgctgggatcacaggcgtgagccactgcgcccagcccactgctagtttgactttttataattgaacctcctggctatgccctgagatcagcgctattttgtaaaccgctgaggtatggataggaacgagtagatcagacctcttgaaaatgcttattcttcctcccttttattttttgtctcttttaagatggtaaaatggttctcagggattcctgccaatactttgaattattttttcctctccatggtatcagtgttcatttccccagttcttgcacaccgctttctgttttggcagttctgccaggcaagccctgtgttccttgggactggttttgctgtggttggatacagataccagcttgccttgatgggattggtattgctgtgtgcttccagccacaggttctcacactcaattccaaagccttcctattgggcgaattccctcaaactctatttgacctgacagccatacgtattcccctctggtagccacagacatgctgtgtttaccaatgtttgctgtttaaattgcatgttctaattccacgtattttccagtctcttttataaagtctcagactataataaacacagcttgcccagtttatcctttcttttttattttaagatgtatgcatattaatcaatttaccatcactggggcatggcagtgtgggcggggagaattattcacattctcctaaaatgacagcagcagagagccttctgcctcagtggctctggctggtttcctgcaggggtcccagtggaaacccgtgtggccacctgttgccgtcttccatgagatgttagtggagagccactttgacgtggaatgatcctaatagatatagccagaccggttttgcggaaacgctttgtgctgagaaccgcaagctggtgcaccctgtgtcatatctgcccccagccagctggaattgtctgcaacacgcggtgcccggtgaggaggcaggcaggacggttgtgtgctgcatccatgagacctggaaattcagtttgcttttggaaaagagcattg

SEQ ID NO: 29306 - DNA, 717 bp, Homo sapiens
agctgggtagtcatcatctctacattccttaggatttctctccctatcaagcgggcccagatacaagtaccaaacagtagtctctgaagttcccccatttccttcagtaccagtctataagctacggtccgccacggattttcatctatcagggtgtcctaatcagaatcagccacccaagcaagcctctcgggcccacatatctatctctggccttcccccatgaacttcagcctgtcgggctagtcggggccccgactagcccgacaagcccctgaatgtgacagtgatccgcaggggggaaaaacaccagcttagacttgttccaacacgctgggcaggaaaaggactgctgggctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgtggtggcagtactgtggcccaccagtgtaatctccctggattaaggcattcttaaaaacttaggcttggcctctttcacaaattaggccacggccctaaataggaattccctggattgtgggcaagtgggcggaagttattctggcaggtactggtgtgattattattattatttttaataaagagttttacagtgctgatatg

SEQ ID NO: 29307 - DNA, 1115 bp, Homo sapiens
actgttctcgcgttcgcggacggctgtggtgttttggcgcatgggcggagccgtagttacggtcgactggggcgtcgtccctagcccgggagccgggtctctggagtcgcggcccggggttcacgatgtccgacgaggaagcgaggcagagcggaggctcctcgcaggccggcgccgtgactgtcagcgacgtccaggagctgatgcggcgcaaggaggagatagaagcgcagatcaaggccaactatgacgtgctggaaagccaaaaaggcattgggatgaacgagccgctggtggactgtgagggctacccccggtcagacgtggacctgtaccaagtccgcaccgccaggcacaacatcatatgcctgcagaatgatcacaaggcagtgatgaagcaggtggaggaggccctgcaccagctgcacgctcgcgacaaggagaagcaggcccgggacatggctgaggcccacaaagaggccatgagccgcaaactgggtcagagtgagagccagggccctccacgggccttcgccaaagtgaacagcatcagccccggctccccagccagcatcgcggtaatccaggggttggccactcaagtccatgcccaggggacacggtgggtcaggtagccttcggggatgtggaaagacagactagttctctccgtgctgcggtgctgagttcagttactcatttaacaaacactgactgaggcctgtcgtgtatccagccctgtgctgggggcagagttttagagaggggtcagccccggctgcccactacattggtgggggagtgacctcttcccagtgacagaagatgataaatgtcccaagagagggagaggatctcttcttggggctcattttagctgggcactgaatgatgaaaatgagaatggcatcttgccaaatgagttatgcatcttatgtgatgtcttaaaaaaaacattaggctgggcacagtggctcatgcgtgtaatcccactactcgggaggctgaggcaggagaatcgcctgaacccaggaggtggaggttgcagtgagcggagatcgtgccactacactccagagcctgggcgacagagtgagactctgtctaaaaaaaaa

SEQ ID NO: 29308 - DNA, 402 bp, Homo sapiens
ataatgggaatccccagtttgcatggaaactgcagataaatcctcgtggtaggaacgagactacagctctagaagcagagggagccccagagtctctcctgggagtctctccagttcattcatgcactaggcatttgctttaaaagaatgaaagaacattggtgaaaaggtcagaagggctcagcctctgaccttcctgaagggagcctccaaacttacgccattccttttcttctttcttccagctgcaacattattcctctgcaaagatgattgtccctggggaacagtaacaggaaagcatcttcccttgccctggacttgggtctagggatttccaacttgtcttctctccctgaagcataaggatctggaagaggcttgtaacctgaacttctgtgt

SEQ ID NO: 29309 - DNA, 4186 bp, Homo sapiens
gccatcagcgccatcttctgggctaccaagtactcacaggacaacaaggaggagtccctgtttctgctgctccagtacctgccccctggggtcatcgccctggtcaacttcctgggtcccctgctgttcacatttctggtccagctggagaactaccctcccaacacggaggtcaacctcactctgatctggtgcgtggtgctgaagctggccagcttggggatgttctccgtctccctgggtcagaccatactgtgcattggcagagacaagagcagctgtgagtcctacggctacaacgtttgtgactatcaggtggctggcagcccggcggggcctgtccctcccttccttctccccaaaaagctcacctcaaactgtgcagagccctgttcctgcccctttagtcacctttgagagaagctgtgagcagggctgcctgcaccgccgcacacctccagggggcgccactgctgccacatggtgtagtgtggctgccctggctgtggggcttcctgctctaatcccatcctcaaggcctgggtttcaacctaacgattctatcagacaccaggcaaggcacctgcaccacagaaaccctcacaggaggctaagggaaggaagggccggggtggccgtgagtggtgacgggtccccttcccctgcaccccagtgctgggagaactccgtgggggaggagctgtacaagctgagtatcttcaacttcctcctcaccgtggccttcgccttcctggtcaccctgcctcggaggctgctggtggaccggttctcaggccggttctgggcctggctggaacgggaggagttcctggtccccaagaatgtgctggacatcgtggcggggcagacggtcacctggatgggcctcttctactgccccctgctgcccctgctgaatagcgtcttcctcttcctcaccttctacatcaagaagtacaccctcctgaagaactccagggcatcttcgcggcccttccgtgcctccagctccaccttcttcttccagctagtgctcctcctgggcctgcttctggctgcagtgcccctgggctatgtggtcagcagccccacttggccatctctcgccagcatccactcctcctgggactgcggcctcttcaccaactactcagcaccctggcaagtggtcccggagctggtggcccttgggctcccgcccattggccagcgtgccctccactacctgggctcccacgccttcagcttccccctcctcatcatgctcaggttctcagggcagcaggggccatgggaggggacacctggagggggaggtccttccttccatgggggtggtgagcctgtgcacccccaaccaggagccagacgcagaaagccaagggaagcaggggcctctgaaaagcaggaacctcctgggcccaccctctgggctgccatggggattgcaggatcactggggaagcaccgtgtctgggtggctgcagctgctgagctattggtattgctgtgccagaggggaggggatgaggggctctgcgaggaaggagaggagggtcccatcctcagatacagcagtgtgcagtgagaagaccccagtaccgcgtattgtagagattgaggtggggagagaggaagtcagggagaggcgcctgtggccccaggggcaactgaccacgaatccccttcccacccaagccttgtcctgacggtgtgcgtctcccagacccaggccaatgccagggccatccacaggctccggaagcagctggtgtgggttcaggagaagtggcacctggtggaggacctgtcgcgactgctgccggagccaggcccgagcgactctccgggccccaagtaccctgcctcccaagcttcgcgcccgcagtccttctgccccggatgcccatgccctggctccccgggccaccaggccccgcggccgggcccctccgtcgtggatgccgcgggactgcgttccccttgccctggacagcacggtgccccggcctccgcccgcagattccgcttccccagcggcgcggagctgtaaccccgacccctgcctccccgaagcctccctggggccccttcaggcctccttactccatcttccagacccctggcgaccaccgcccctctcagtggctccagggcctccctcagaggtccccaaagatggacacacaaccccagcggcagcaggaaaaacatatgggaattttctttctatattttaatctcatccctttaaaatgtctattttttattgtgttttttataatatacataatctattagtatagtatctcttgaatgcgattttttctagaatgtgttctgctgatttgttttagagccatgagtgcaatttatacacatacatctattgggaatgctcagaagttgtttactgatggaagtgccttcagaagagtccgggaaccacttcctaaggaaggaaagagctggccacagttagagcaagcctgcctggggccctgctctgtgttccagctgcaaactgcctgcatcatcccttcctgttactcttccttcacctgagacagtcgaggccacagcgtcagccagggccagagctgggatttgaacccaggcactcgggctccagagccacactgccccagtgtggggcttagtggcggctcctggccctgactgaggggctgactgaagcctggtgagagcgtgctgggtcagcctctccctggcgggaatcctctccgtccagtcttctaacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttccaagcctcctgttctcccacccccacccctgccatgctgcagtgactaaatctgtggttctcatccttggagaacacctgagtagctgctacaagctggccacagcccagcgactctgatgtggttgggctgggtgtggccagcagccagggcatcgggacttttcgaagctcccaggtgactcaccggcagctggggatgagaactgtcaggagggaaggtcagaagtcccaggatgcacttgaaaagcctctagctccaccagtgaccagctcctggctggactcctggtctggactcagcatcagggaggctctggcctctcgccctcagggctgggggcttcttcacatggtcatcaaagacttggccagttccgcctctcccacggccgtccttgtctcacccagcatcacgacgcatcagttcaccaacaaacacgattcagtgctgctagtgctgggtcctgttctgggggctggtgatgaggccaagagggaaagagggagctctgtgttccatcgagggggcgacaagcctggaccagatgaaagtgactcatgttgttaattagcggcttagggccaaaggtggcccctggaccagtggcctcagcatcacctgggaaaaggttagaaatgaacattcccaggccccacctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgacttttaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaccttggggaccttttggcccccgtaaattttaaattctagcaagttatggcttgcgctcgaatttggggctatttggtccaatgccccttatagaggacggttttaaattaaattgcccggggttaaccaaattaactcttggaaaaccccgggttttcccaacttaattccttttgaac

SEQ ID NO: 29310 - DNA, 3757 bp, Homo sapiens
gccatcagcgccatcttctgggctaccaagtactcacaggacaacaaggaggagtccctgtttctgctgctccagtacctgccccctggggtcatcgccctggtcaacttcctgggtcccctgctgttcacatttctggtccagctggagaactaccctcccaacacggaggtcaacctcactctgatctggtgcgtggtgctgaagctggccagcttggggatgttctccgtctccctgggtcagaccatactgtgcattggcagagacaagagcagctgtgagtcctacggctacaacgtttgtgactatcaggtggctggcagcccggcggggcctgtccctcccttccttctccccaaaaagctcacctcaaactgtgcagagccctgttcctgcccctttagtcacctttgagagaagctgtgagcagggctgcctgcaccgccgcacacctccagggggcgccactgctgccacatggtgtagtgtggctgccctggctgtggggcttcctgctctaatcccatcctcaaggcctgggtttcaacctaacgattctatcagacaccaggcaaggcacctgcaccacagaaaccctcacaggaggctaagggaaggaagggccggggtggccgtgagtggtgacgggtccccttcccctgcaccccagtgctgggagaactccgtgggggaggagctgtacaagctgagtatcttcaacttcctcctcaccgtggccttcgccttcctggtcaccctgcctcggaggctgctggtggaccggttctcaggccggttctgggcctggctggaacgggaggagttcctggtccccaagaatgtgctggacatcgtggcggggcagacggtcacctggatgggcctcttctactgccccctgctgcccctgctgaatagcgtcttcctcttcctcaccttctacatcaagaagtacaccctcctgaagaactccagggcatcttcgcggcccttccgtgcctccagctccaccttcttcttccagctagtgctcctcctgggcctgcttctggctgcagtgcccctgggctatgtggtcagcagccccacttggccatctctcgccagcatccactcctcctgggactgcggcctcttcaccaactactcagcaccctggcaagtggtcccggagctggtggcccttgggctcccgcccattggccagcgtgccctccactacctgggctcccacgccttcagcttccccctcctcatcatgctcagccttgtcctgacggtgtgcgtctcccagacccaggccaatgccagggccatccacaggctccggaagcagctggtgtgggttcaggagaagtggcacctggtggaggacctgtcgcgactgctgccggagccaggcccgagcgactctccgggccccaagtaccctgcctcccaagcttcgcgcccgcagtccttctgccccggatgcccatgccctggctccccgggccaccaggccccgcggccgggcccctccgtcgtggatgccgcgggactgcgttccccttgccctggacagcacggtgccccggcctccgcccgcagattccgcttccccagcggcgcggagctgtaaccccgacccctgcctccccgaagcctccctggggccccttcaggcctccttactccatcttccagacccctggcgaccaccgcccctctcagtggctccagggcctccctcagaggtccccaaagatggacacacaaccccagcggcagcaggaaaaacatatgggaattttctttctatattttaatctcatccctttaaaatgtctattttttattgtgttttttataatatacataatctattagtatagtatctcttgaatgcgattttttctagaatgtgttctgctgatttgttttagagccatgagtgcaatttatacacatacatctattgggaatgctcagaagttgtttactgatggaagtgccttcagaagagtccgggaaccacttcctaaggaaggaaagagctggccacagttagagcaagcctgcctggggccctgctctgtgttccagctgcaaactgcctgcatcatcccttcctgttactcttccttcacctgagacagtcgaggccacagcgtcagccagggccagagctgggatttgaacccaggcactcgggctccagagccacactgccccagtgtggggcttagtggcggctcctggccctgactgaggggctgactgaagcctggtgagagcgtgctgggtcagcctctccctggcgggaatcctctccgtccagtcttctaacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttccaagcctcctgttctcccacccccacccctgccatgctgcagtgactaaatctgtggttctcatccttggagaacacctgagtagctgctacaagctggccacagcccagcgactctgatgtggttgggctgggtgtggccagcagccagggcatcgggacttttcgaagctcccaggtgactcaccggcagctggggatgagaactgtcaggagggaaggtcagaagtcccaggatgcacttgaaaagcctctagctccaccagtgaccagctcctggctggactcctggtctggactcagcatcagggaggctctggcctctcgccctcagggctgggggcttcttcacatggtcatcaaagacttggccagttccgcctctcccacggccgtccttgtctcacccagcatcacgacgcatcagttcaccaacaaacacgattcagtgctgctagtgctgggtcctgttctgggggctggtgatgaggccaagagggaaagagggagctctgtgttccatcgagggggcgacaagcctggaccagatgaaagtgactcatgttgttaattagcggcttagggccaaaggtggcccctggaccagtggcctcagcatcacctgggaaaaggttagaaatgaacattcccaggccccacctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgacttttaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaccttggggaccttttggcccccgtaaattttaaattctagcaagttatggcttgcgctcgaatttggggctatttggtccaatgccccttatagaggacggttttaaattaaattgcccggggttaaccaaattaactcttggaaaaccccgggttttcccaacttaattccttttgaac

SEQ ID NO: 29311 - DNA, 3680 bp, Homo sapiens
gccatcagcgccatcttctgggctaccaagtactcacaggacaacaaggaggagtccctgtttctgctgctccagtacctgccccctggggtcatcgccctggtcaacttcctgggtcccctgctgttcacatttctggtccagctggagaactaccctcccaacacggaggtcaacctcactctgatctgtgctgggagaactccgtgggggaggagctgtacaagctgagtatcttcaacttcctcctcaccgtggccttcgccttcctggtcaccctgcctcggaggctgctggtggaccggttctcaggccggttctgggcctggctggaacgggaggagttcctggtccccaagaatgtgctggacatcgtggcggggcagacggtcacctggatgggcctcttctactgccccctgctgcccctgctgaatagcgtcttcctcttcctcaccttctacatcaagaagtacaccctcctgaagaactccagggcatcttcgcggcccttccgtgcctccagctccaccttcttcttccagctagtgctcctcctgggcctgcttctggctgcagtgcccctgggctatgtggtcagcagcatccactcctcctgggactgcggcctcttcaccaactactcagcaccctggcaagtggtcccggagctggtggcccttgggctcccgcccattggccagcgtgccctccactacctgggctcccacgccttcagcttccccctcctcatcatgctcaggttctcagggcagcaggggccatgggaggggacacctggagggggaggtccttccttccatgggggtggtgagcctgtgcacccccaaccaggagccagacgcagaaagccaagggaagcaggggcctctgaaaagcaggaacctcctgggcccaccctctgggctgccatggggattgcaggatcactggggaagcaccgtgtctgggtggctgcagctgctgagctattggtattgctgtgccagaggggaggggatgaggggctctgcgaggaaggagaggagggtcccatcctcagatacagcagtgtgcagtgagaagaccccagtaccgcgtattgtagagattgaggtggggagagaggaagtcagggagaggcgcctgtggccccaggggcaactgaccacgaatccccttcccacccaagccttgtcctgacggtgtgcgtctcccagacccaggccaatgccagggccatccacaggctccggaagcagctggtgtgggttcaggagaagtggcacctggtggaggacctgtcgcgactgctgccggagccaggcccgagcgactctccgggccccaagtaccctgcctcccaagcttcgcgcccgcagtccttctgccccggatgcccatgccctggctccccgggccaccaggccccgcggccgggcccctccgtcgtggatgccgcgggactgcgttccccttgccctggacagcacggtgccccggcctccgcccgcagattccgcttccccagcggcgcggagctgtaaccccgacccctgcctccccgaagcctccctggggccccttcaggcctccttactccatcttccagacccctggcgaccaccgcccctctcagtggctccagggcctccctcagaggtccccaaagatggacacacaaccccagcggcagcaggaaaaacatatgggaattttctttctatattttaatctcatccctttaaaatgtctattttttattgtgttttttataatatacataatctattagtatagtatctcttgaatgcgattttttctagaatgtgttctgctgatttgttttagagccatgagtgcaatttatacacatacatctattgggaatgctcagaagttgtttactgatggaagtgccttcagaagagtccgggaaccacttcctaaggaaggaaagagctggccacagttagagcaagcctgcctggggccctgctctgtgttccagctgcaaactgcctgcatcatcccttcctgttactcttccttcacctgagacagtcgaggccacagcgtcagccagggccagagctgggatttgaacccaggcactcgggctccagagccacactgccccagtgtggggcttagtggcggctcctggccctgactgaggggctgactgaagcctggtgagagcgtgctgggtcagcctctccctggcgggaatcctctccgtccagtcttctaacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttccaagcctcctgttctcccacccccacccctgccatgctgcagtgactaaatctgtggttctcatccttggagaacacctgagtagctgctacaagctggccacagcccagcgactctgatgtggttgggctgggtgtggccagcagccagggcatcgggacttttcgaagctcccaggtgactcaccggcagctggggatgagaactgtcaggagggaaggtcagaagtcccaggatgcacttgaaaagcctctagctccaccagtgaccagctcctggctggactcctggtctggactcagcatcagggaggctctggcctctcgccctcagggctgggggcttcttcacatggtcatcaaagacttggccagttccgcctctcccacggccgtccttgtctcacccagcatcacgacgcatcagttcaccaacaaacacgattcagtgctgctagtgctgggtcctgttctgggggctggtgatgaggccaagagggaaagagggagctctgtgttccatcgagggggcgacaagcctggaccagatgaaagtgactcatgttgttaattagcggcttagggccaaaggtggcccctggaccagtggcctcagcatcacctgggaaaaggttagaaatgaacattcccaggccccacctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgacttttaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaccttggggaccttttggcccccgtaaattttaaattctagcaagttatggcttgcgctcgaatttggggctatttggtccaatgccccttatagaggacggttttaaattaaattgcccggggttaaccaaattaactcttggaaaaccccgggttttcccaacttaattccttttgaac

SEQ ID NO: 29312 - DNA, 3828 bp, Homo sapiens
gccatcagcgccatcttctgggctaccaagtactcacaggacaacaaggaggagtccctgtttctgctgctccagtacctgccccctggggtcatcgccctggtcaacttcctgggtcccctgctgttcacatttctggtccagctggagaactaccctcccaacacggaggtcaacctcactctgatctggtgcgtggtgctgaagctggccagcttggggatgttctccgtctccctgggtcagaccatactgtgcattggcagagacaagagcagctgtgagtcctacggctacaacgtttgtgactatcagtgctgggagaactccgtgggggaggagctgtacaagctgagtatcttcaacttcctcctcaccgtggccttcgccttcctggtcaccctgcctcggaggctgctggtggaccggttctcaggccggttctgggcctggctggaacgggaggagttcctggtccccaagaatgtgctggacatcgtggcggggcagacggtcacctggatgggcctcttctactgccccctgctgcccctgctgaatagcgtcttcctcttcctcaccttctacatcaagaagtacaccctcctgaagaactccagggcatcttcgcggcccttccgtgcctccagctccaccttcttcttccagctagtgctcctcctgggcctgcttctggctgcagtgcccctgggctatgtggtcagcagccccacttggccatctctcgccagcatccactcctcctgggactgcggcctcttcaccaactactcagcaccctggcaagtggtcccggagctggtggcccttgggctcccgcccattggccagcgtgccctccactacctgggctcccacgccttcagcttccccctcctcatcatgctcaggttctcagggcagcaggggccatgggaggggacacctggagggggaggtccttccttccatgggggtggtgagcctgtgcacccccaaccaggagccagacgcagaaagccaagggaagcaggggcctctgaaaagcaggaacctcctgggcccaccctctgggctgccatggggattgcaggatcactggggaagcaccgtgtctgggtggctgcagctgctgagctattggtattgctgtgccagaggggaggggatgaggggctctgcgaggaaggagaggagggtcccatcctcagatacagcagtgtgcagtgagaagaccccagtaccgcgtattgtagagattgaggtggggagagaggaagtcagggagaggcgcctgtggccccaggggcaactgaccacgaatccccttcccacccaagccttgtcctgacggtgtgcgtctcccagacccaggccaatgccagggccatccacaggctccggaagcagctggtgtgggttcaggagaagtggcacctggtggaggacctgtcgcgactgctgccggagccaggcccgagcgactctccgggccccaagtaccctgcctcccaagcttcgcgcccgcagtccttctgccccggatgcccatgccctggctccccgggccaccaggccccgcggccgggcccctccgtcgtggatgccgcgggactgcgttccccttgccctggacagcacggtgccccggcctccgcccgcagattccgcttccccagcggcgcggagctgtaaccccgacccctgcctccccgaagcctccctggggccccttcaggcctccttactccatcttccagacccctggcgaccaccgcccctctcagtggctccagggcctccctcagaggtccccaaagatggacacacaaccccagcggcagcaggaaaaacatatgggaattttctttctatattttaatctcatccctttaaaatgtctattttttattgtgttttttataatatacataatctattagtatagtatctcttgaatgcgattttttctagaatgtgttctgctgatttgttttagagccatgagtgcaatttatacacatacatctattgggaatgctcagaagttgtttactgatggaagtgccttcagaagagtccgggaaccacttcctaaggaaggaaagagctggccacagttagagcaagcctgcctggggccctgctctgtgttccagctgcaaactgcctgcatcatcccttcctgttactcttccttcacctgagacagtcgaggccacagcgtcagccagggccagagctgggatttgaacccaggcactcgggctccagagccacactgccccagtgtggggcttagtggcggctcctggccctgactgaggggctgactgaagcctggtgagagcgtgctgggtcagcctctccctggcgggaatcctctccgtccagtcttctaacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttccaagcctcctgttctcccacccccacccctgccatgctgcagtgactaaatctgtggttctcatccttggagaacacctgagtagctgctacaagctggccacagcccagcgactctgatgtggttgggctgggtgtggccagcagccagggcatcgggacttttcgaagctcccaggtgactcaccggcagctggggatgagaactgtcaggagggaaggtcagaagtcccaggatgcacttgaaaagcctctagctccaccagtgaccagctcctggctggactcctggtctggactcagcatcagggaggctctggcctctcgccctcagggctgggggcttcttcacatggtcatcaaagacttggccagttccgcctctcccacggccgtccttgtctcacccagcatcacgacgcatcagttcaccaacaaacacgattcagtgctgctagtgctgggtcctgttctgggggctggtgatgaggccaagagggaaagagggagctctgtgttccatcgagggggcgacaagcctggaccagatgaaagtgactcatgttgttaattagcggcttagggccaaaggtggcccctggaccagtggcctcagcatcacctgggaaaaggttagaaatgaacattcccaggccccacctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgacttttaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaccttggggaccttttggcccccgtaaattttaaattctagcaagttatggcttgcgctcgaatttggggctatttggtccaatgccccttatagaggacggttttaaattaaattgcccggggttaaccaaattaactcttggaaaaccccgggttttcccaacttaattccttttgaac

SEQ ID NO: 29313 - DNA, 2469 bp, Homo sapiens
cacacccgctcgtgggaagcagcgcctgtcgcaactcgccacttgttctcctcacagcaggttcaggagaagtggcacctggtggaggacctgtcgcgactgctgccggagccaggcccgagcgactctccgggccccaagtaccctgcctcccaagcttcgcgcccgcagtccttctgccccggatgcccatgccctggctccccgggccaccaggccccgcggccgggcccctccgtcgtggatgccgcgggactgcgttccccttgccctggacagcacggtgccccggcctccgcccgcagattccgcttccccagcggcgcggagctgtaaccccgacccctgcctccccgaagcctccctggggccccttcaggcctccttactccatcttccagacccctggcgaccaccgcccctctcagtggctccagggcctccctcagaggtccccaaagatggacacacaaccccagcggcagcaggaaaaacatatgggaattttctttctatattttaatctcatccctttaaaatgtctattttttattgtgttttttataatatacataatctattagtatagtatctcttgaatgcgattttttctagaatgtgttctgctgatttgttttagagccatgagtgcaatttatacacatacatctattgggaatgctcagaagttgtttactgatggaagtgccttcagaagagtccgggaaccacttcctaaggaaggaaagagctggccacagttagagcaagcctgcctggggccctgctctgtgttccagctgcaaactgcctgcatcatcccttcctgttactcttccttcacctgagacagtcgaggccacagcgtcagccagggccagagctgggatttgaacccaggcactcgggctccagagccacactgccccagtgtggggcttagtggcggctcctggccctgactgaggggctgactgaagcctggtgagagcgtgctgggtcagcctctccctggcgggaatcctctccgtccagtcttctaacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttccaagcctcctgttctcccacccccacccctgccatgctgcagtgactaaatctgtggttctcatccttggagaacacctgagtagctgctacaagctggccacagcccagcgactctgatgtggttgggctgggtgtggccagcagccagggcatcgggacttttcgaagctcccaggtgactcaccggcagctggggatgagaactgtcaggagggaaggtcagaagtcccaggatgcacttgaaaagcctctagctccaccagtgaccagctcctggctggactcctggtctggactcagcatcagggaggctctggcctctcgccctcagggctgggggcttcttcacatggtcatcaaagacttggccagttccgcctctcccacggccgtccttgtctcacccagcatcacgacgcatcagttcaccaacaaacacgattcagtgctgctagtgctgggtcctgttctgggggctggtgatgaggccaagagggaaagagggagctctgtgttccatcgagggggcgacaagcctggaccagatgaaagtgactcatgttgttaattagcggcttagggccaaaggtggcccctggaccagtggcctcagcatcacctgggaaaaggttagaaatgaacattcccaggccccacctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgacttttaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaccttggggaccttttggcccccgtaaattttaaattctagcaagttatggcttgcgctcgaatttggggctatttggtccaatgccccttatagaggacggttttaaattaaattgcccggggttaaccaaattaactcttggaaaaccccgggttttcccaacttaattccttttgaac

SEQ ID NO: 29314 - DNA, 2227 bp, Homo sapiens
gcaggctgtacggtccgagtctttggcctgcctggcttggcaggagtcgtctgagaaggggactcctccaggacttggtccctaggtccccagatggggagactgaggccgtggctgtgtgtccctctgagagttggagcggggctgggcccgaattcgaccccagcaggattctctccctctcagtggctccagggcctccctcagaggtccccaaagatggacacacaaccccagcggcagcaggaaaaacatatgggaattttctttctatattttaatctcatccctttaaaatgtctattttttattgtgttttttataatatacataatctattagtatagtatctcttgaatgcgattttttctagaatgtgttctgctgatttgttttagagccatgagtgcaatttatacacatacatctattgggaatgctcagaagttgtttactgatggaagtgccttcagaagagtccgggaaccacttcctaaggaaggaaagagctggccacagttagagcaagcctgcctggggccctgctctgtgttccagctgcaaactgcctgcatcatcccttcctgttactcttccttcacctgagacagtcgaggccacagcgtcagccagggccagagctgggatttgaacccaggcactcgggctccagagccacactgccccagtgtggggcttagtggcggctcctggccctgactgaggggctgactgaagcctggtgagagcgtgctgggtcagcctctccctggcgggaatcctctccgtccagtcttctaacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttccaagcctcctgttctcccacccccacccctgccatgctgcagtgactaaatctgtggttctcatccttggagaacacctgagtagctgctacaagctggccacagcccagcgactctgatgtggttgggctgggtgtggccagcagccagggcatcgggacttttcgaagctcccaggtgactcaccggcagctggggatgagaactgtcaggagggaaggtcagaagtcccaggatgcacttgaaaagcctctagctccaccagtgaccagctcctggctggactcctggtctggactcagcatcagggaggctctggcctctcgccctcagggctgggggcttcttcacatggtcatcaaagacttggccagttccgcctctcccacggccgtccttgtctcacccagcatcacgacgcatcagttcaccaacaaacacgattcagtgctgctagtgctgggtcctgttctgggggctggtgatgaggccaagagggaaagagggagctctgtgttccatcgagggggcgacaagcctggaccagatgaaagtgactcatgttgttaattagcggcttagggccaaaggtggcccctggaccagtggcctcagcatcacctgggaaaaggttagaaatgaacattcccaggccccacctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgacttttaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaccttggggaccttttggcccccgtaaattttaaattctagcaagttatggcttgcgctcgaatttggggctatttggtccaatgccccttatagaggacggttttaaattaaattgcccggggttaaccaaattaactcttggaaaaccccgggttttcccaacttaattccttttgaac

SEQ ID NO: 29315 - DNA, 3321 bp, Homo sapiens
gccatcagcgccatcttctgggctaccaagtactcacaggacaacaaggaggagtccctgtttctgctgctccagtacctgccccctggggtcatcgccctggtcaacttcctgggtcccctgctgttcacatttctggtccagctggagaactaccctcccaacacggaggtcaacctcactctgatctggtgcgtggtgctgaagctggccagcttggggatgttctccgtctccctgggtcagaccatactgtgcattggcagagacaagagcagctgtgagtcctacggctacaacgtttgtgactatcaggtggctggcagcccggcggggcctgtccctcccttccttctccccaaaaagctcacctcaaactgtgcagagccctgttcctgcccctttagtcacctttgagagaagctgtgagcagggctgcctgcaccgccgcacacctccagggggcgccactgctgccacatggtgtagtgtggctgccctggctgtggggcttcctgctctaatcccatcctcaaggcctgggtttcaacctaacgattctatcagacaccaggcaaggcacctgcaccacagaaaccctcacaggaggctaagggaaggaagggccggggtggccgtgagtggtgacgggtccccttcccctgcaccccagtgctgggagaactccgtgggggaggagctgtacaagctgagtatcttcaacttcctcctcaccgtggccttcgccttcctggtcaccctgcctcggaggctgctggtggaccggttctcaggccggttctgggcctggctggaacgggaggagttcctggtccccaagaatgtgctggacatcgtggcggggcagacggtcacctggatgggcctcttctactgccccctgctgcccctgctgaatagcgtcttcctcttcctcaccttctacatcaagaagtacaccctcctgaagaactccagggcatcttcgcggcccttccgtgcctccagctccaccttcttcttccagctagtgctcctcctgggcctgcttctggctgcagtgcccctgggctatgtggtcagcagccccacttggccatctctcgccagcatccactcctcctgggactgcggcctcttcaccaactactcagcaccctggcaagtggtcccggagctggtggcccttgggctcccgcccattggccagcgtgccctccactacctgggctcccacgccttcagcttccccctcctcatcatgctcaggttctcagggcagcaggggccatgggaggggacacctggagggggaggtccttccttccatgggggtggtgagcctgtgcacccccaaccaggagccagacgcagaaagccaagggaagcaggggcctctgaaaagcaggaacctcctgggcccaccctctgggctgccatggggattgcaggatcactggggaagcaccgtgtctgggtggctgcagctgctgagctattggtattgctgtgccagaggggaggggatgaggggctctgcgaggaaggagaggagggtcccatcctcagatacagcagtgtgcagtgagaagaccccagtaccgcgtattgtagagattgaggtggggagagaggaagtcagggagaggcgcctgtggccccaggggcaactgaccacgaatccccttcccacccaagccttgtcctgacggtgtgcgtctcccagacccaggccaatgccagggccatccacaggctccggaagcagctggtgtgggttcaggagaagtggcacctggtggaggacctgtcgcgactgctgccggagccaggcccgagcgactctccgggccccaagtaccctgcctcccaagcttcgcgcccgcagtccttctgccccggatgcccatgccctggctccccgggccaccaggccccgcggccgggcccctccgtcgtggatgccgcgggactgcgttccccttgccctggacagcacggtgccccggcctccgcccgcagattccgcttccccagcggcgcggagctgtaaccccgacccctgcctccccgaagcctccctggggccccttcaggcctccttactccatcttccagacccctggcgaccaccgcccctctcagtggctccagggcctccctcagaggtccccaaagatggacacacaaccccagcggcagcaggaaaaacatatgggaattttctttctatattttaatctcatccctttaaaatgtctattttttattgtgttttttataatatacataatctattagtatagtatctcttgaatgcgattttttctagaatgtgttctgctgatttgttttagagccatgagtgcaatttatacacatacatctattgggaatgctcagaagttgtttactgatggaagtgccttcagaagagtccgggaaccacttcctaaggaaggaaagagctggccacagttagagcaagcctgcctggggccctgctctgtgttccagctgcaaactgcctgcatcatcccttcctgttactcttccttcacctgagacagtcgaggccacagcgtcagccagggccagagctgggatttgaacccaggcactcgggctccagagccacactgccccagtgtggggcttagtggcggctcctggccctgactgaggggctgactgaagcctggtgagagcgtgctgggtcagcctctccctggcgggaatcctctccgtccagtcttctaacctagcagcctcacgtccacagagctgccttgtgaaactcagcagagccctggcttcctgcagagccgtgttctcccagcctgctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgacttttaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaccttggggaccttttggcccccgtaaattttaaattctagcaagttatggcttgcgctcgaatttggggctatttggtccaatgccccttatagaggacggttttaaattaaattgcccggggttaaccaaattaactcttggaaaaccccgggttttcccaacttaattccttttgaac

SEQ ID NO: 29316 - DNA, 2273 bp, Homo sapiens
gccatcagcgccatcttctgggctaccaagtactcacaggacaacaaggaggagtccctgtttctgctgctccagtacctgccccctggggtcatcgccctggtcaacttcctgggtcccctgctgttcacatttctggtccagctggagaactaccctcccaacacggaggtcaacctcactctgatctggtgcgtggtgctgaagctggccagcttggggatgttctccgtctccctgggtcagaccatactgtgcattggcagagacaagagcagctgtgagtcctacggctacaacgtttgtgactatcaggtggctggcagcccggcggggcctgtccctcccttccttctccccaaaaagctcacctcaaactgtgcagagccctgttcctgcccctttagtcacctttgagagaagctgtgagcagggctgcctgcaccgccgcacacctccagggggcgccactgctgccacatggtgtagtgtggctgccctggctgtggggcttcctgctctaatcccatcctcaaggcctgggtttcaacctaacgattctatcagacaccaggcaaggcacctgcaccacagaaaccctcacaggaggctaagggaaggaagggccggggtggccgtgagtggtgacgggtccccttcccctgcaccccagtgctgggagaactccgtgggggaggagctgtacaagctgagtatcttcaacttcctcctcaccgtggccttcgccttcctggtcaccctgcctcggaggctgctggtggaccggttctcaggccggttctgggcctggctggaacgggaggagttcctggtccccaagaatgtgctggacatcgtggcggggcagacggtcacctggatgggcctcttctactgccccctgctgcccctgctgaatagcgtcttcctcttcctcaccttctacatcaagaagtacaccctcctgaagaactccagggcatcttcgcggcccttccgtgcctccagctccaccttcttcttccagctagtgctcctcctgggcctgcttctggctgcagtgcccctgggctatgtggtcagcagccccacttggccatctctcgccagcatccactcctcctgggactgcggcctcttcaccaactactcagcaccctggcaagtggtcccggagctggtggcccttgggctcccgcccattggccagcgtgccctccactacctgggctcccacgccttcagcttccccctcctcatcatgctcaggttctcagggcagcaggggccatgggaggggacacctggagggggaggtccttccttccatgggggtggtgagcctgtgcacccccaaccaggagccagacgcagaaagccaagggaagcaggggcctctgaaaagcaggaacctcctgggcccaccctctgggctgccatggggattgcaggatcactggggaagcaccgtgtctgggtggctgcagctgctgagctattggtattgctgtgccagaggggaggggatgaggggctctgcgaggaaggagaggagggtcccatcctcagatacagcagtgtgcagtgagaagaccccagtaccgcgtattgtagagattgaggtggggagagaggaagtcagggagaggcgcctgtggccccaggggcaactgaccacgaatccccttcccacccaagccttgtcctgacggtgtgcgtctcccagacccaggccaatgccagggccatccacaggctccggaagcagctggtgtgggtgagtgtcctcggggctggtgaggggacagcagcttcagtggaaacccttccctatgtgtggccgagggcctagaacacgtctgagcgggtcaggtgggttcttcccactggagggcgtggcctcaggctgagagtgaagacggggaaggggaggaagagaacagctcgggctcctgagaccaggagccagacctggtaagtacatgaccttaggggctgggcctttgcctgtaatcccaacgctttggaggcccaggcaggaggatcggatcacttgaagccatgagttaaaaccagcctgggcaacaaagcaagaccctggtctccaccaaaaataagtaattaattttttaaaaggagaatgtggccgggcgtggtgactcacgcctgtaatcccagcactttcagaggccgaggtgggtggatcacctgaggtcaggagttcaagaccagcctggccaaaatagcgaaaccccgtctctacttaaaaaaaa

SEQ ID NO: 29317 - DNA, 743 bp, Homo sapiens
gcaggctgtacggtccgagtctttggcctgcctggcttggcaggagtcgtctgagaaggggactcctccaggacttggtccctaggtccccagatggggagactgaggccgtggctgtgtgtccctctgagagttggagcggggctgggcccgaattcgaccccagcaggattctctctcatttctgagccccggaggtggcagagcggcagacccgggcaagtgaaccctagggctgcaggagcccaggccccgacgccggcgcagaggggacggaagggcccgcccccagcccagcgtgcacagaggccatagccaaggccttaaggctcatccaaccggggactcatatcccccccaccggcagcccggcgccccagcctctacccgtgcccgccgagatgctgctgccgcggtcggtgtcatcggagcgggcccctggggtgccggagccggaggagctgtgggaggcagagatggagcggctgcgcggctctgggacgcccgtgcgcgggctgccctatgccatgatggacaagcgcctcatctggcagctgcgggagcccgcgggggtgcagaccttgcgctggcagcggtggcagcgccggcggcagacggtggaaaggcgcctgcgggaggcagcgcagcggctggcccgggggccttgggctctgggagggggcgctctacgagatcgggggcctcttcggcacaggaattcggtcctacttcaccttcctccg

SEQ ID NO: 29318 - DNA, 657 bp, Homo sapiens
  misc_feature (65)..(66): n is a, c, g, or t
  misc_feature (69)..(69): n is a, c, g, or t
cgccggatatagttggaactaccagtaacctcttaaagggtattatactatctctctctcctcgnnccnaattcggcacgaggttgttaattagcggcttagggccaaaggtggcccctggaccagtggcctcagcatcacctgggaaaaggttagaaatgaacattcccaggccccacctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgacttttaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaccttggggaccttttggcccccgtaaattttaaattctagcaagttatggcttgcgctcgaatttggggctatttggtccaatgccccttatagaggacggttttaaattaaattgcccggggttaaccaaattaactcttggaaaaccccgggttttcccaacttaattccttttgaac

SEQ ID NO: 29319 - DNA, 499 bp, Homo sapiens
ccttgagaggcaaccgaagcactcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgacttttaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaccttggggaccttttggcccccgtaaattttaaattctagcaagttatggcttgcgctcgaatttggggctatttggtccaatgccccttatagaggacggttttaaattaaattgcccggggttaaccaaattaactcttggaaaaccccgggttttcccaacttaattccttttgaac

SEQ ID NO: 29320 - DNA, 770 bp, Homo sapiens
gccatcagcgccatcttctgggctaccaagtactcacaggacaacaaggaggagtccctgtttctgctgctccagtacctgccccctggggtcatcgccctggtcaacttcctgggtcccctgctgttcacatttctggtccagctggagaactaccctcccaacacggaggtcaacctcactctgatctggtgcgtggtgctgaagctggccagcttggggatgttctccgtctccctgggtcagaccatactgtgcattggcagagacaagagcagctgtgagtcctacggctacaacgtttgtgactatcagtgctgggagaactccgtgggggaggagctgtacaagctgagtatcttcaacttcctcctcaccgtggccttcgccttcctggtcaccctgcctcggaggctgctggtggaccggttctcaggccggtttggagagggacaggaggaaacgcgagcctggtgggactggctccaggcacacaggcgaagggcaagagggttggacacgaagccaccaagctacttgggttcctccttcttctcgtttgcctttttctgcttctgctgcatgatctccgagtccctctgcttgcgggcggcagcagaaagcccgtcatctcggcgctttcccttaaccgagtcgctctgctttttcatattcttctggcgggcgagctcacgctggtaccgccggtcatggcgacggcagcggctccaacctgcctcctcctgcccctctcagggatcctccagcat

SEQ ID NO: 29321 - DNA, 687 bp, Homo sapiens
ctgcaccgatctgggtcaacgcctctgatcgtatctcgtgtccatccttctcattcccacccaggtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgcccaggctggacaggagcctggccctggggagaagagggcctgttgcatcagcctctgaccttggccagcaccacctgcccccactggctttttggtgccccttgtccccacttcagccccaggacctttccttgccctttggttccagatatcagactgttccctgttcacagcaccctcagggtcttaaggtcttcatgccctatcacaaatacctcttttatctgtccacccctcacagactaggaccctcaaataaagctgttttatatcaatgc

SEQ ID NO: 29322 - DNA, 131 bp, Homo sapiens
gcctactactactaaattcccccccggtcgaccagggtcttaaggtcttcatgccctatcacaaatacctcttttatctgtccacccctcacagactaggaccctcaaataaagctgttttatatcaatgc

SEQ ID NO: 29323 - DNA, 1251 bp, Homo sapiens
cccggtgttgcgctcaccgccgtggggcagggccaacgggagaaacaaaaaaggaagcctgataaacagtttccatatccaacattttccacattcaattatttttaaattaaataatctctccctaggagaaaaaggaaagttctcgctcagcttccgtcctctctgcttccttacagcacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaaggtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgcccaggctggacaggagcctggccctggggagaagagggcctgttgcatcagcctctgaccttggccagcaccacctgcccccactggctttttggtgccccttgtccccacttcagccccaggacctttccttgccctttggttccagatatcagactgttccctgttcacagcaccctcagggtcttaaggtcttcatgccctatcacaaatacctcttttatctgtccacccctcacagactaggaccctcaaataaagctgttttatatcaatgc

SEQ ID NO: 29324 - DNA, 1055 bp, Homo sapiens
cccggtgttgcgctcaccgccgtggggcagggccaacgggagaaacaaaaaaggaagcctgataaacagtttccatatccaacattttccacattcaattatttttaaattaaataatctctccctaggagaaaaaggaaagttctcgctcagcttccgtcctctctgcttccttacagcacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaagggtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgcccaggctggacaggagcctggccctggggagaagagggcctgttgcatcagcctctgaccttggccagcaccacctgcccccactggctttttggtgccccttgtccccacttcagccccaggacctttccttgccctttggttccagatatcagactgttccctgttcacagcaccctcagggtcttaaggtcttcatgccctatcacaaatacctcttttatctgtccacccctcacagactaggaccctcaaataaagctgttttatatcaatgc

SEQ ID NO: 29325 - DNA, 1189 bp, Homo sapiens
cccggtgttgcgctcaccgccgtggggcagggccaacgggagaaacaaaaaaggaagcctgataaacagtttccatatccaacattttccacattcaattatttttaaattaaataatctctccctaggagaaaaaggaaagttctcgctcagcttccgtcctctctgcttccttacagcacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaaggtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgcccaggctggacaggagcctggccctggggagaagagggcctgttgcatcagcctctgaccttggccagcaccacctgcccccactggctttttggtgccccttgtccccacttcagccccaggacctttccttgccctttggttccagatatcagactgttccctgttcacagcaccctcagggtcttaaggtcttcatgccctatcacaaatacctcttttatctgtccacccctcacagactaggaccctcaaataaagctgttttatatcaatgc

SEQ ID NO: 29326 - DNA, 939 bp, Homo sapiens
cccggtgttgcgctcaccgccgtggggcagggccaacgggagaaacaaaaaaggaagcctgataaacagtttccatatccaacattttccacattcaattatttttaaattaaataatctctccctaggagaaaaaggaaagttctcgctcagcttccgtcctctctgcttccttacagcacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaaggtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctacccagctgtgctgccagcatctggccttccggggcttctagatgatccttcaatgctcatacagcgatgcgc

SEQ ID NO: 29327 - DNA, 483 bp, Homo sapiens
tcaaacacaggagggcccccacagtcaccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgcccaggctggacaggagcctggccctggggagaagagggcctgttgcatcagcctctgaccttggccagcaccacctgcccccactggctttttggtgccccttgtccccacttcagccccaggacctttccttgccctttggttccagatatcagactgttccctgttcacagcaccctcagggtcttaaggtcttcatgccctatcacaaatacctcttttatctgtccacccctcacagactaggaccctcaaataaagctgttttatatcaatgc

SEQ ID NO: 29328 - DNA, 169 bp, Homo sapiens
tgatagggcactgaagaccttaagaccctttggttccagatatcagactgttccctgttcacagcaccctcagggtcttaaggtcttcatgccctatcacaaatacctcttttatctgtccacccctcacagactaggaccctcaaataaagctgttttatatcaatgc

SEQ ID NO: 29329 - DNA, 408 bp, Homo sapiens
ggagatcagtgtcgtagaaaataacaaaacaaatattgaggatagagcgctggggtggttgtaatgggaaagggtgcctttggcagcaggaatgataagcacaaagtacacacctgctctgctggaggaacagggagggggacgctggctggagcagactgaacgaggagaagcatggtagagatgaggagagacaggtaacatgaaactgaaatatggacagatcatgcatggccatgcaggctgctttggcttctactctgcagagtggaataacaagttgattgaaatttgcttgactgcccaatatctccttgtagcacttttctcctcttactagcagtatttccactcctatctccccacctcaggtggtctgcggttttaactcttagtttcctatgtggt

SEQ ID NO: 29330 - DNA, 205 bp, Homo sapiens
tgtcggtgcgtccggaccccgcagccccccagtgccgcccgggggcggtgggagaggggccgacaccgcagggcccgccgtgctgtggccgagggggcaggtccaggctctgcttcccgggcagacgccggagaccccagcaagccaagtgctgcgggcagcccccccccgcccccccgagagaggggacgccgcgtggaggcca

SEQ ID NO: 29331 - DNA, 341 bp, Homo sapiens
atcttatccaaaaaaactcacagaaacacacaacacacacataactaaatatctgggtaccctagaaccaaaaaagtagtatgtagtatgtatgagtgtattaataagatagaaaaatatgacagaatgttaaaaattggtgattatgaacaaagggttattttgaataagcaaaaagattatgaatatgacagttgtcttattttggcaactttgcattttaaatcatttaaaaataaaattaaaaaaattaattgaccacttgggaggctgaggcaggaggatctcttgagcccaggagttcaaggccagcgtgggcaatgtagtaagaccccgtctct

SEQ ID NO: 29332 - DNA, 202 bp, Homo sapiens
tccaggggggccccacagtaaaatattccaggcttttgggtctctctgaagccactttggaggctgcttaggaggcatatttgcttgaccaagcgatagaaatcctagagaaactcaggcctcagcaaagatttttcctcattcaccaaaaaagcaacaacagtagcagcagcagcaaggctgtgggcttttcctgctgatc

SEQ ID NO: 29333 - DNA, 481 bp, Homo sapiens
aaaatagctcttgggccccttccatatgcttagtgctgggctctggggcttccagacagacgtcagcccctctgacaacacaaaaagcagcgtacagaggcacgcagaaagctcctgaatgctagtcacctctctaatatttgatgtctgcagcatttcctgcattatctttttccccttagcaatggtcacttttgtacatattatatatgtgcatatatatttttttttctgcatatccctctaaactgtaacctccacgtggccagggattttatgttttgttcctgcttgtatccttagtgcctacaacagaagtatgtgttgaatgatgaatgccacagtcccctttatggacagagccagcatcagaagccaagcagaaggagtacctccagaagcaaacctctgttctaaccagaaatcagaaccaagatagaacaagaattaaacatgaactgaacactctctgaacccggct

SEQ ID NO: 29334 - DNA, 522 bp, Homo sapiens
atgattatcttccaggacctcatcagccacaatgagatgttctctgacatttacaagatctgggagatcacaaatgggctgtgcctggaagtggagcagaagatgctcagtaagacaacagggaacactgatgactcactcattggcagaaattcctcctctgaaagtactgaggatgaagttactgaaagcacgataatcactagtgttgatattgttacaaaccatcacttgcaggaaagcatcttcacaaaagaagcctacaagaagtatatcaaagattacatgaaatcaatcaacgaaaaacttgaagaacagagaccagaaagagtgaaactttttataacagggaatgaagaacaaatcaagcacatctttgctaattttcaaaactaccagttctttattggtgaaaacctaaatccacctggcatggttgctctgctgaactaccgtaaggatggtcagtatgaccccatatatgattttttaaggaatggtttagaaattaaaagatgttaa

SEQ ID NO: 29335 - DNA, 358 bp, Homo sapiens
gcaccattatgagatggggtggaggagccaatcctgcaacaatggtctgggcagaagttcatgcaaatatgcatgatgttttaatgaaaatgtgatgttgccaatgctaacttcacacgtgcagtcatattaccatgacaaccagtagctctctagagttcaaatatggagtaatgacttgcttatgcctgaacatttaacttaacagtttttcatgctgctaacaatgattaaattgaaaaagaactctgagccaaatctgacagatatgggaaaaattcatttctgaaagcaatatctaaaataattgctggctacatttgcttcctaattctgagaaaaaaaatcccaaactgtg

SEQ ID NO: 29336 - DNA, 937 bp, Homo sapiens
cggacgcgtgggtcgacccacgcgtcggtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctggcagattggtacccaactgttgcatcagtaccccattctatcatcaacgggtacaaacgagtcctggcttgtttgtggagacggattacaccttcccacttgctgaaaaggtcaaggctttcttggctgatccatctgcctttgtggctgctgcccctgtggctgctgccacca

SEQ ID NO: 29337 - DNA, 788 bp, Homo sapiens
  misc_feature (43)..(43): n is a, c, g, or t
gccttctctcgccaggcgtcctcgtggaaggcccgggaccgcnggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgtgtgccagctgatcaagactggcaagaaaatcacagcctttgtacccaatgacggttgcttgaactttattgaggaaaatgatgaagttctggttgctggattggtcgcaaaggtcatgctgttggtgatattcctggagtcgctttaaggttgtcaaagtagccaatgtttctctttggcccta

SEQ ID NO: 29338 - DNA, 932 bp, Homo sapiens
tcctgggtgttagggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctggcagattggtacccaactgttgcatcagtaccccattctatcatcaacgggtacaaacgagtcctggcttgtttgtggagacggattacaccttcccacttgctgaaaaggtcaaggctttcttggctgatccatctgcctttgtggctgctgcccctgtggctgctgccacca

SEQ ID NO: 29339 - DNA, 993 bp, Homo sapiens
  misc_feature (43)..(43): n is a, c, g, or t
gccttctctcgccaggcgtcctcgtggaaggcccgggaccgcnggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctggcagattggtacccaactgttgcatcagtaccccattctatcatcaacgggtacaaacgagtcctggcttgtttgtggagacggattacaccttcccacttgctgaaaaggtcaaggctttcttggctgatccatctgcctttgtggctgctgcccctgtggctgctgccacca

SEQ ID NO: 29340 - DNA, 746 bp, Homo sapiens
tcctgggtgttagggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgggtgtccgcaatgttgccagtgtctgtctggcagattggtacccaactgttgcatcagtaccccattctatcatcaacgggtacaaacgagtcctggcttgtttgtggagacggattacaccttcccacttgctgaaaaggtcaaggctttcttggctgatccatctgcctttgtggctgctgcccctgtggctgctgccacca

SEQ ID NO: 29341 - DNA, 637 bp, Homo sapiens
cggacgcgtgggtcgacccacgcgtcggtggaagtgacatcgtctttaaaccctgcgtggcaatccctgacgcaccgccgtgatgcccagggaagacagggcgacctggaagtccaactacttccttaagatcatccaactattggatgattatcctgaatatgtttcacttgatggtgaggcgagactaatgtgggctccaacgtctaggatgccagcaacgaatccggacatgtcctcatttcgtcggtggacatgggcctgttggggatagacgatttgcaatttggagggcaacatgaatcgacctcgatgtatgcgcaatggctcgatcacgaggggcacctgcgaaatatcaacaccagtctctgggaggagaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgtgagtggacctggtttgcctgtg

SEQ ID NO: 29342 - DNA, 694 bp, Homo sapiens
gttatactacagtgctggttccgtagtcttcaaagcttggaactccctcttgcctttgctccaaaaatttgttctttcactcagcaaatatttaccaagtttctgctatatgcaggaccgtgtggagaactcaaagatgaatcagacgtggggcctgtccacaaatgttgtcagtcaagtgtaggacatagggcaagcacacgggagcttttgctgttgtgtccaagaatagcatgatgcgccgtaggtatttggtgggggaaggaaattagtgggtgggtttcaagtaaacccacatggagaaggtgacatttgagttgagccttgaaggacaggtttatctgtgcagagagggaagttttagggcagagatatagcacaaaagttagaaaacaaaaccaaaacaggtggaagagaggaagagtaatcaacctttaactgcgttgccatgcccttgactgaggcctcacccacattatcccatctaatcctcctcataagaaaacttttttcctcataagaaaactaaggcctgcagcattaaaataacttgcccgagaaggctcataagtggttagagtggagatttgaacccaagacagttcaattccagatttgaactgagcaggctttagccagagcaaaagatatttgaagagaaaaaggagtaatttgaagagataaagtttaggaa

SEQ ID NO: 29343 - DNA, 441 bp, Homo sapiens
aaatgtagctttacgttgcagagtacggtaaactagcagtctatgccatagaccatataatgcaatttggatatcaccctataagttattctaagtataataagatgttatacaagtcaaaaatggttagttgcctataactttctaacactcagtcattgttgggtattttgcagtgattatcaggctagagttactgaaagagttgagttttaggtaagcttgattttttgggcttaccagggcacatgccttggatcagtccctgtactctgaaacccaaaggtcagatctgcactggaattttccactaattgagacaactaagtagctctctcgaaaacaaaactcacaagattgctttacacaatgagtttaatatattttcaggcgtattaggtagaattctgtgggttacaaatagtagaaactgactctaga

SEQ ID NO: 29344 - DNA, 480 bp, Homo sapiens
aatcctctgcgtcgacgtaacttgtagtgaaatacttcctagtgttctcttcttctagttgtccatatgtagtatgtataactatagaccttgatgatttaagttgagcacagtttagtgtcaggttcctttcagtgatgcatgagattggttatatgatctagtgagtgttatttagaaattaattcaccagacccgggtgtggtggctcatgcctgtaatcccagcactatgggagggcgaggcaggcagatcacctgaggtcaggagttcgagaccagcctggccaacatggtgaaaccctgtctctactaaaaatatgaaaattatctgggcgtggtgatgctcgcctgcaatcccagctacttgggaggctgaggcatgagaattgcttgaacctgggggacaggtgttacagtgagccaagattgtgccactgcactccagcctgggtgacagagtgagactctgtctcaaaaa

SEQ ID NO: 29345 - DNA, 703 bp, Homo sapiens
cctccaccctcacccccctttttgactcaaattttattgtgagttggtgtatagttaggaatttgaagagcactttttttgtttattttatcttttcggttactatgcatactatgtgtgtcaactcttaaacctgcagggggtcattttggccatcaactagttttagggctttcgcctcctaaagaatatgaattatggttgtaatttttacagtttaacaagatggcatatgaagaatctttatttcattatgacttcctagtgttctcttcttctagttgtccatatgtagtatgtataactatagaccttgatgatttaagttgagcacagtttagtgtcaggttcctttcagtgatgcatgagattggttatatgatctagtgagtgttatttagaaattaattcaccagacccgggtgtggtggctcatgcctgtaatcccagcactatgggagggcgaggcaggcagatcacctgaggtcaggagttcgagaccagcctggccaacatggtgaaaccctgtctctactaaaaatatgaaaattatctgggcgtggtgatgctcgcctgcaatcccagctacttgggaggctgaggcatgagaattgcttgaacctgggggacaggtgttacagtgagccaagattgtgccactgcactccagcctgggtgacagagtgagactctgtctcaaaaa

SEQ ID NO: 29346 - DNA, 184 bp, Homo sapiens
ctattgctaatctacctttttgccagtttaatttgcagcctcccaagaattaaccctaagaggttagaggaaaagtttctcctctctgactttcataaccacagaacatgtcccaccacataccccgtcattattgtgagaatataattcaactagacatggaggtaactaacctcagtgaatc

SEQ ID NO: 29347 - DNA, 643 bp, Homo sapiens
ggtttctctattttgcccaggctgttcttgaactcctgagctcaaaagatcctttcatcttggttttccagagtgctaggactataaggcatgagccacagtgctcagtccatcatcccttcttgaatcttagactttccttttagtacaggcataccttggagacattgcaggtacgattccagaccactgcaataaggcaagttcctggttatttattattgttttggtttctcagtgcatataaaagttatgtgtacacaatactatagtctcttaagtgtttttatggttaaaaaacacaatgtgactaccttaattaaaatatattttgtgttaaaaatgctaatgatcggccgtggttcacgcctgtaatcctagcactttgggattacaggcatgggccaccatgcctggccttaccttccaatttatacactatagttactgaggatttaaattatatcttcattttattcctatcaattagacattgttatatttctgatatttcttgtctttgacatcaatatttagatttcactccatgtttaccattttatttgctcatcatcccgtcttcgtttctttttctttttttacttttttttttgagacagggtctccctctgttggcggccgc

SEQ ID NO: 29348 - DNA, 477 bp, Homo sapiens
ggtttctctattttgcccaggctgttcttgaactcctgagctcaaaagatcctttcatcttggttttccagagtgctaggactataaggcatgagccacagtgctcagtccatcatcccttcttgaatcttagactttccttttagtacaggcataccttggagacattgcaggtacgattccagaccactgcaataaggcaagttcctggttatttattattgttttggtttctcagtgcatataaaagttatgtgtacacaatactatagtctcttaagtgtttttatggttaaaaaacacaatgtgactaccttaattaaaatatattttgtgttaaaaatgctaatgatcggccgtggttcacgcctgtaatcctagcactttgggaggttgaggggggcggatcacttgcggtcaggagttcaaggccagcctggccaacatggtgaaaccctgtctctactacaaatattt

SEQ ID NO: 29349 - DNA, 2842 bp, Homo sapiens
tggcgatgctactgtttaattgcaggaggtgggggtgtgtgtaccatgtaccagggctattagaagcaagaaggaaggagggagggcagagcgccctgctgagcaacaaaggactcctgcagccttctctgtctgtctcttggcacaggcacatggggaggcctcccgcaggtggggggccaccagtccaggggtgggagcactacagggcacgagttggtttgggagctgccagtctcctgggaggatcgcagtcagcagagcagggctgaggcctgggggtaggagcagagcctgcgcatctggaggcagcatgtccaagaaagggagtggaggtgcagcgaaggacccaggggcagagcccacgctgggatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccgcatcatcaaccagaaacagttccagcggctgcgggcattgctgggctgcggccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccgctacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggctcccccagcctcaggttgctggagctgtcacatgactgcatcctgcctgccagggctgcaaagcaaggtcttgcttctatctgggggacgctgctcgagagaggccgagaggccgcagaacatgccaggtgtcctcactcaccccaccctccccaattccagccctttgccctctcggtcagggttggccaggcccagtcacaggggcagtgtcaccctggaaaatacagtgccctgccttcttaggggcatcagccctgaacggttgagagcgtggagccctccaggcctttgctctcccctctaggcacacgcgcacttccacctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctggagagcctatatttctga

SEQ ID NO: 29350 - DNA, 2519 bp, Homo sapiens
  misc_feature (2)..(2): n is a, c, g, or t
  misc_feature (6)..(6): n is a, c, g, or t
  misc_feature (8)..(8): n is a, c, g, or t
gncacnanggtgaagaaggatgtggttgcttccccttccaccataactgatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccgcatcatcaaccagaaacagttccagcggctgcgggcattgctgggctgcggccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccgctacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggctcccccagcctcaggttgctggagctgtcacatgactgcatcctgcctgccagggctgcaaagcaaggtcttgcttctatctgggggacgctgctcgagagaggccgagaggccgcagaacatgccaggtgtcctcactcaccccaccctccccaattccagccctttgccctctcggtcagggttggccaggcccagtcacaggggcagtgtcaccctggaaaatacagtgccctgccttcttaggggcatcagccctgaacggttgagagcgtggagccctccaggcctttgctctcccctctaggcacacgcgcacttccacctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctggagagcctatatttctga

SEQ ID NO: 29351 - DNA, 595 bp, Homo sapiens
attgccaggcgtgggcacgggagttggtttgggagctgccagtctcctgggaggatcgcagtcagcagagcagggctgaggcctgggggtaggagcagagcctgcgcatctggaggcagcatgtccaagaaagggagtggaggtgcagcgaaggacccaggggcagagcccacgctgggatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcaggtgaggagggcgttccgaaccc

SEQ ID NO: 29352 - DNA, 2394 bp, Homo sapiens
  misc_feature (2)..(2): n is a, c, g, or t
  misc_feature (6)..(6): n is a, c, g, or t
  misc_feature (8)..(8): n is a, c, g, or t
gncacnanggtgaagaaggatgtggttgcttccccttccaccataactgatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccgcatcatcaaccagaaacagttccagcggctgcgggcattgctgggctgcggccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgccacagtgggatgggccggtaccacggcaagttcaccttcgacaccttctcccaccaccgcacctgcctgctcgccccctccggcctggagaaattaaaggagatccgctacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggctcccccagcctcaggttgctggagctgtcacatgactgcatcctgcctgccagggctgcaaagcaaggtcttgcttctatctgggggacgctgctcgagagaggccgagaggccgcagaacatgccaggtgtcctcactcaccccaccctccccaattccagccctttgccctctcggtcagggttggccaggcccagtcacaggggcagtgtcaccctggaaaatacagtgccctgccttcttaggggcatcagccctgaacggttgagagcgtggagccctccaggcctttgctctcccctctaggcacacgcgcacttccacctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctggagagcctatatttctga

SEQ ID NO: 29353 - DNA, 2513 bp, Homo sapiens
  misc_feature (26)..(26): n is a, c, g, or t
  misc_feature (29)..(29): n is a, c, g, or t
gggtgaacacagagtggttatgcttnccnttccaccataactgatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccgcatcatcaaccagaaacagttccagcggctgcgggcattgctgggctgcggccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccgctacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggctcccccagcctcaggttgctggagctgtcacatgactgcatcctgcctgccagggctgcaaagcaaggtcttgcttctatctgggggacgctgctcgagagaggccgagaggccgcagaacatgccaggtgtcctcactcaccccaccctccccaattccagccctttgccctctcggtcagggttggccaggcccagtcacaggggcagtgtcaccctggaaaatacagtgccctgccttcttaggggcatcagccctgaacggttgagagcgtggagccctccaggcctttgctctcccctctaggcacacgcgcacttccacctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctggagagcctatatttctga

SEQ ID NO: 29354 - DNA, 2767 bp, Homo sapiens
  misc_feature (31)..(31): n is a, c, g, or t
ggggatgtcgttgctgttacttccaccatanctgcagatgctgctggctccgtgattatttcaccgagcaccagatgtgcacatgtgaggacaggcgacgactgcccagaaagggcaggggttcctctgccccacctgcctcacctgggaaagctgtgaccacgctgaggccaggttcctgggatgaacatcaggacacctgtgtgccatagctcatcccagactcctccaatccgggtcttgattcaggccggaggcggtcatccctccaaaggcaccagggagccatggaagaggatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccgcatcatcaaccagaaacagttccagcggctgcgggcattgctgggctgcggccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccgctacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggctcccccagcctcaggttgctggagctgtcacatgactgcatcctgcctgccagggctgcaaagcaaggtcttgcttctatctgggggacgctgctcgagagaggccgagaggccgcagaacatgccaggtgtcctcactcaccccaccctccccaattccagccctttgccctctcggtcagggttggccaggcccagtcacaggggcagtgtcaccctggaaaatacagtgccctgccttcttaggggcatcagccctgaacggttgagagcgtggagccctccaggcctttgctctcccctctaggcacacgcgcacttccacctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctggagagcctatatttctga

SEQ ID NO: 29355 - DNA, 2518 bp, Homo sapiens
tggggcatggatggtattgtacttggcctgttcgcggcatgtacattgatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccgcatcatcaaccagaaacagttccagcggctgcgggcattgctgggctgcggccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccgctacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggctcccccagcctcaggttgctggagctgtcacatgactgcatcctgcctgccagggctgcaaagcaaggtcttgcttctatctgggggacgctgctcgagagaggccgagaggccgcagaacatgccaggtgtcctcactcaccccaccctccccaattccagccctttgccctctcggtcagggttggccaggcccagtcacaggggcagtgtcaccctggaaaatacagtgccctgccttcttaggggcatcagccctgaacggttgagagcgtggagccctccaggcctttgctctcccctctaggcacacgcgcacttccacctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctggagagcctatatttctga

SEQ ID NO: 29356 - DNA, 1992 bp, Homo sapiens
  misc_feature (2)..(2): n is a, c, g, or t
  misc_feature (6)..(6): n is a, c, g, or t
  misc_feature (8)..(8): n is a, c, g, or t
gncacnanggtgaagaaggatgtggttgcttccccttccaccataactgatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggctcccccagcctcaggttgctggagctgtcacatgactgcatcctgcctgccagggctgcaaagcaaggtcttgcttctatctgggggacgctgctcgagagaggccgagaggccgcagaacatgccaggtgtcctcactcaccccaccctccccaattccagccctttgccctctcggtcagggttggccaggcccagtcacaggggcagtgtcaccctggaaaatacagtgccctgccttcttaggggcatcagccctgaacggttgagagcgtggagccctccaggcctttgctctcccctctaggcacacgcgcacttccacctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctggagagcctatatttctga

SEQ ID NO: 29357 - DNA, 1648 bp, Homo sapiens
gcccgcataccacactgcagcatcctaacctcaccgtcgcgactcaaggctgccggctccccatgatcctgcagggcttcctggtctttgcgccatggtggtaatcacccccatggcaccccgaccgtcactgagagggtgctgtccccagaagatgcttagagcggagattattgcccgttagagggtggaggggcaggtgaggatgaggctcacctccgctgtggaatgtgcggggctcaagccctcttctcatgactagagcccaacacccaccttctcactccctggcaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccgctacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggctcccccagcctcaggttgctggagctgtcacatgactgcatcctgcctgccagggctgcaaagcaaggtcttgcttctatctgggggacgctgctcgagagaggccgagaggccgcagaacatgccaggtgtcctcactcaccccaccctccccaattccagccctttgccctctcggtcagggttggccaggcccagtcacaggggcagtgtcaccctggaaaatacagtgccctgccttcttaggggcatcagccctgaacggttgagagcgtggagccctccaggcctttgctctcccctctaggcacacgcgcacttccacctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctggagagcctatatttctga

SEQ ID NO: 29358 - DNA, 2370 bp, Homo sapiens
  misc_feature (2)..(2): n is a, c, g, or t
  misc_feature (6)..(6): n is a, c, g, or t
  misc_feature (8)..(8): n is a, c, g, or t
gncacnanggtgaagaaggatgtggttgcttccccttccaccataactgatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccgcatcatcaaccagaaacagttccagcggctgcgggcattgctgggctgcggccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccgctacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggctcccccagcctcaggttgctggagctgtcacatgactgcatcctgcctgccagggctgcaaagcaaggtcttgcttctatctgggggacgctgctcgagagaggccgagaggccgcagaacatgccaggtgtcctcactcaccccaccctccccaattccagccctttgccctctcggtcagggttggccaggcccagtcacaggggcagtgtcaccctggaaaatacagtgccctgccttcttaggggcatcagccctgaacggttgagagcgtggagccctccaggcctttgctctcccctctaggcacacgcgcacttccacctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagtccgttcgcatgttgggtatcctctagagt

SEQ ID NO: 29359 - DNA, 1097 bp, Homo sapiens
  misc_feature (2)..(2): n is a, c, g, or t
  misc_feature (6)..(6): n is a, c, g, or t
  misc_feature (8)..(8): n is a, c, g, or t
gncacnanggtgaagaaggatgtggttgcttccccttccaccataactgatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccgcatcatcaaccagaaacagttccaagtcaagcctgtctgaaaagggtcgacaggtagatgctgaggaatacttaggcttcattctagatggacttcatgaggaaatgttgaccctaaagaagcttctctcaccaagtaatgaaagacttacgatttccaacaggcccaaaaaccactcggtcaatgaagaagagcag

SEQ ID NO: 29360 - DNA, 1114 bp, Homo sapiens
  misc_feature (1052)..(1052): n is a, c, g, or t
  misc_feature (1055)..(1055): n is a, c, g, or t
  misc_feature (1110)..(1110): n is a, c, g, or t
tggcgatgctactgtttaattgcaggaggtgggggtgtgtgtaccatgtaccagggctattagaagcaagaaggaaggagggagggcagagcgccctgctgagcaacaaaggactcctgcagccttctctgtctgtctcttggcacaggcacatggggaggcctcccgcaggtggggggccaccagtccaggggtgggagcactacagggcacgagttggtttgggagctgccagtctcctgggaggatcgcagtcagcagagcagggctgaggcctgggggtaggagcagagcctgcgcatctggaggcagcatgtccaagaaagggagtggaggtgcagcgaaggacccaggggcagagcccacgctggggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccgcatcatcaaccagaaacagttccagcggctgcgggcattgctgggctgcggccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcgaatcggcaagtggatggccgtacacgnaantcactcacactctccacacgactgctgtcgcctcggctgagaataaggaatcgtncact

SEQ ID NO: 29361 - DNA, 842 bp, Homo sapiens
tggcgatgctactgtttaattgcaggaggtgggggtgtgtgtaccatgtaccagggctattagaagcaagaaggaaggagggagggcagagcgccctgctgagcaacaaaggactcctgcagccttctctgtctgtctcttggcacaggcacatggggaggcctcccgcaggtggggggccaccagtccaggggtgggagcactacagggcacgagttggtttgggagctgccagtctcctgggaggatcgcagtcagcagagcagggctgaggcctgggggtaggagcagagcctgcgcatctggaggcagcatgtccaagaaagggagtggaggtgcagcgaaggacccaggggcagagcccacgctgggcagatgctgctggctccgtgattatttcaccgagcaccagatgtgcacatgtgaggacaggcgacgactgcccagaaagggcaggggttcctctgccccacctgcctcacctgggaaagctgtgaccacgctgaggccaggttcctgggatgaacatcaggacacctgtgtgccatagctcatcccagactcctccaatccgggtcttgattcaggccggaggcggtcatccctccaaaggcaccagggagccatggaagaggttagagctgagctgatgtggccaggagctgcttgagcgccgggtggaggctgctgacgctcgcatgccaggcaaagctttgggtcagggccctggaacctgggacctggaagcgctccaggccaataccgcccgctaccagagaagggcccaggccccacccaggttctagcccaagggcttgagcaaagacagtagatgaatattt

SEQ ID NO: 29362 - DNA, 252 bp, Homo sapiens
ttctcactccctggcaggttgtgaaccagatgctggagcggaccagcagcggcagctttggaggcaatgagggcttcacctacatatctctgctgtccgtgccattcgggggagtcgcggtgggtccctgcccatttccacccctagggaagcttggctttggtaccccagacccaggaagtcccttcactcactgttcaaccttgatccacaccctgggcctctcaaggcctcagtttccctatctgtaaa

SEQ ID NO: 29363 - DNA, 394 bp, Homo sapiens
cagcttgaattttccttttagcttactgattttgggggtccaagatattttcctttcacaccagtcagccctgccccagcaagcgcccggacccctgccctgcagcaggtgggcgagacaagaaagcaccttgcatgagaggcagggcttgggtccagctccagcccccatctgtttcctcatccgtcaggcagatgctgctggctccgtgattatttcaccgagcaccagatgtgcacatgtgaggacaggcgacgactgcccagaaagggcaggggttcctctgccccacctgcctcacctgggaaagctgtgaccacgctgaggccaggttcctgggatgaacatcaggacacctgtgtgccatagctcatcccagactcctccaatccgg

SEQ ID NO: 29364 - DNA, 2040 bp, Homo sapiens
tctgtaattcatggctaatccgaagagtttgattgagttgatggcggcagggaccagatagacaccttggtgattgtctttggccataagaatagaccaaggataggttttccagagacaccttcatactgtaaacatggtttagacacggtcatagggaaggctgctggtccatcatttgttctgaacaaatggcatttcctgctcctgaccctggcagttggccccagattccttgtcgatgacttggaaacgtccattctgggtaaggtcagcactccctgagagatgttaacaaagtttacctatgagtcttactgtgtagacaatctgaagtcaattttagttacacaatcagcattcccatgtgtcctcagtgtcttatcaatgaactatgtgtatcaagccatactaaactggagtttagcaggacaaaggcaaactaaatgtagaacataacatatcagctgaatatgtctatccaggactgtttttctagaacataaatcatggagctccttgacagtgtatccactgtttttggggtttaataaaaccaactagaatttagacttaaaaagaaattattattccttttggttgtccacataaagtagtccagggctatcatatggctaaaatcaagttatttggttcatctctggtatgtatttataaagtcaacttatcagccattaagatggagatttgctttaaatttttgcagtgtgtgtggcagtcagaaaaacccatatctagttttcaacttcacctctggtgtttttatggcttaaccttatatcattgatccaacatctagcctgatgctggagctcttatttctagcctgatgctggagctcttatatctagcctgatgctggagctcttgaagctgactcttggaagtttggagggtgtagagtttcccatctagtatttaatttgtccctgtgccattagtcccagcttgaagtcatttgccagtgtcgatgttgacaggattgtgacaatattgcctttcataaaaccgagaaccaaagaattccattattctaacaaagcctgagtttcatagattgtgggcacatctagacagatatgtgcatgcttgatggtgcagagaaactgctgacttccaccaacctcatgctccccctggctggccatacagagggattcgttgtcatattgaaaaggctctgaaagatgagtttctaattgaagctcactatctcaggttggtgtttctactgtgtagtcccaagcctgtatccatatcataaaagtggaggcctggtactcctccaggttatctggccagtgtagactcctccatctgaatatgaacctccagggtaagaatttttcagacatgtctatactgaacagtaggatcctgcactttccaaatgtctgcctccttttgttcttcattgacccattctaattcctgttaggtgtgagaagaattgtcttcagttctctctccattctcattcatgatggaatcattgatccattgaccagttgagaaatgattgatgctgaagaagtggtattctattggtaaggcttattaccaaacttccgataatgaagcaggctaccaaaaacttatccagcccaccctaggagtgtttggatttgatcatggatgtagcatacaccaaaatccaccgagacctttgcaaaattaggctacttgttttattttgccagattatcatgggagagtctttaactagttctgaatatttgtaagtctgagtacttcatagaattataaagaaggtacagctgaccccttctcaccatgttgtaaatatttactgagactgggtgcagtactgagggataataatcttctgatttatcaaatcctgactgtctagagcaaattgtacactctctttgtgaatggtcctgtaacgtgtatgaacacatttctgggtgccttagaagttgtatttttcatgtgtgctaatatgcagtatttatacattgtgagaagctgctttgaataaaaaggttgaaactt

SEQ ID NO: 29365 - DNA, 2412 bp, Homo sapiens
  misc_feature (2186)..(2186): n is a, c, g, or t
tctgtaattcatggctaatccgaagagtttgattgagttgatggcggcagggaccagatagacaccttggtgattgtctttggccataagaatagaccaaggataggttttccagagacaccttcatactgtaaacatggtttagacacggtcatagggaaggctgctggtccatcatttgttctgaacaaatggcatttcctgctcctgaccctggcagttggccccagattccttgtcgatgacttggaaacgtccattctgggtaaggtcagcactccctgagagatgttaacaaagtttacctatgagtcttactgtgtagacaatctgaagtcaattttagttacacaatcagcattcccatgtgtcctcagtgtcttatcaatgaactatgtgtatcaagccatactaaactggagtttagcaggacaaaggcaaactaaatgtagaacataacatatcagctgaatatgtctatccaggactgtttttctagaacataaatcatggagctccttgacagtgtatccactgtttttggggtttaataaaaccaactagaatttagacttaaaaagaaattattattccttttggttgtccacataaagtagtccagggctatcatatggctaaaatcaagttatttggttcatctctggtatgtatttataaagtcaacttatcagccattaagatggagatttgctttaaatttttgcagtgtgtgtggcagtcagaaaaacccatatctagttttcaacttcacctctggtgtttttatggcttaaccttatatcattgatccaacatctagcctgatgctggagctcttatttctagcctgatgctggagctcttatatctagcctgatgctggagctcttgaagctgactcttggaagtttggagggtgtagagtttcccatctagtatttaatttgtccctgtgccattagtcccagcttgaagtcatttgccagtgtcgatgttgacaggattgtgacaatattgcctttcataaaaccgagaaccaaagaattccattattctaacaaagcctgagtttcatagattgtgggcacatctagacagatatgtgcatgcttgatggtgcagagaaactgctgacttccaccaacctcatgctccccctggctggccatacagagggattcgttgtcatattgaaaaggctctgaaagatgagtttctaattgaagctcactatctcaggttggtgtttctactgtgtagtcccaagcctgtatccatatcataaaagtggaggcctggtactcctccaggttatctggccagtgtagactcctccatctgaatatgaacctccagggtaagaatttttcagacatgtctatactgaacagtaggatcctgcactttccaaatgtctgcctccttttgttcttcattgacccattctaattcctgttaggtgtgagaagaattgtcttcagttctctctccattctcattcatgatggaatcattgatccattgaccagttgagaaatgattgatgctgaagaagtggtattctattggtaaggcttattaccaaacttccgataatgaagcaggctaccaaaaacttatccagcccaccctaggagtgtttggatttgatcatggatgtagcatacaccaaaatccaccgagacctttgcaaaattaggctacttgttttattttgccagattatcatgggagagtctttaactagttctgaatatttgtaagtctgagtacttcatagaattataaagaaggtacagctgaccccttctcaccatgttgtaaatatttactgagactgggtgcagtactgagggataataatcttctgatttatcaaatcctgactgtctagagcaaattgtacactctctttgtgaatggtcctgtaacgtgtatgaacacatttctgggtgccttagaagttgtatttttcatgtgtgctaatatgcagtatttatacattgtgagaagctgctttgaataaaaaggttgaaacttaaaaaaaaaaaaaaaacaaaaaaaaaaaaacctgtgttgtgcgcgcgcgcgcccgtgggccctggaagaaggttttctaaaacccttcgcgttggggcgcgcgcgggggccccctgaggttaagagtgcaccaggggtcatacgcnggtgtcccctccaaggaagaaacgcgggtcctgtgacatcagagggtgtggtgatttttccccccattataaaaagaaggccgcgggggggagacaccgaagtcgtcttcctgaaacaatattacccagaaggagatctccggaagggaccaatcacacggggctctcttattccacaagggaggttcccaaagggggaaaccatcataattcaaatattagccga

SEQ ID NO: 29366 - DNA, 426 bp, Homo sapiens
gattttaaaagaattttggagccaccacacccagcctatgatttcatcctttttaagactgaaactattattttgtataatatatttgtatatctatatatctctatctgtctagctcatactttgtcctttcatgtgtcagtagacacttgggttgcttccaccttccacctttttggctaatatctctttgagatcctgctttcaattcttttggatatgtacccagaagtgggattgctggattgtatcgtaattccatttttaactttttgtaaaattttcttttgcatttaggctatttcattttttctcaggttaaactttggacatcgtaaccagtctcacaaagagatgaaatatgaaccacaataagcttgcttcagttttacctcttccgtgatttagtttgctgctgtttgtaag

SEQ ID NO: 29367 - DNA, 451 bp, Homo sapiens
aatttctattctgccatcttagaagttatttagttaaaaacagttcaatacattcaaatctacagtaaatgtctgacaatctcttttaagatgaattataggggacaattggtttgccaggagcatgctaaggtcaagaccctaaacataacatagtacaatgaacataattccaattgcttttttctgtttaatattaaaaagaaaagatttttttgtctacgtgcttttttcagattttcttcaagtgttgacatgtaataaacttaagtagaagcatcagaaatagcataatgatttgctgctaccaagacaggattgatctgaatttgatttagccatagaaatacctcctgtgagaggaaggccaggtgtagtttagaggaggcagatttgggcattgccactccctggttttcttatctcaggtaagttacttagtgatatggtt

SEQ ID NO: 29368 - DNA, 465 bp, Homo sapiens
tgtctaattttctttcctagcacctctgccatttataaattatatttcgcttggactggtgcaatagcaaactggtcttttagctctctcctttttgattcattgttcacatcaatgccaagtaaatcttcccacaacccagctcagacccactcttctcaccagagacttttcccccatggacaatggatttagaacaaactccttggcctgctatttgaggctaccagcagactggtcaaagtcacccttttcaactttatttcctggcattctggagattcgcccgctcacgactgtcggtgcacaggtatttgcaagcttttccatcagcctgcctttgtgcatgccctttgctccttggcatgctttcctctccctctctttagcatacatcacaacctgccttacatgtttctctctgtatctgtcccatgccgtccctcccctcccccctcccccgga

SEQ ID NO: 29369 - DNA, 566 bp, Homo sapiens
cttaagggtgaagtgatgaagggagcgggaggggagtcctaaacatcctctaccaccttgatgaaaagacaagccggttttcaatacttatagaggcttgggaacactgcaaaccccttgcatcaaatgagacccttcaagaagccctgtcagaggtgttgaacagcattaattcagctcaggtttacttcaaagcaggacttgatgtgttcaagagtgtcttggatgggaagaattgagaaaactctgagcatttttaaaagtttgtttacaattccacaagcaaaagctctaatttaaccagattttctgacattgaaggcttattttccccaatggctttttgacaagtataaagctattattacattgtattttttaaatgtaaatatagaaagaacattttgcacatttaatatttttcttatatctacatttctgaatatgtaaagcaagttattgaaataggacttaagaattacctattaaaaagaaatctgatatataaaaatatgtactattttaaggaaaaaaaaaacaaaattgggcctcgttgggcctcagcg

SEQ ID NO: 29370 - DNA, 2488 bp, Homo sapiens
aggagaagtgattttgcaaattgccaacgaacctgttctgccctttaatgcacttgatatagctttagaagttcaaaacaaccttaaaggtgatcaacccaacactcatcaactgttagccatggcgtcacgcctgcgggagagtgctgaactttttcagtctgatgagatgcgacctgctaatgatcccaaggagagagcacccatccgcatccggatgctgaatgacattctccaagacatggagaaaagctttctggtaaagcaggcaccaccaggtttttatagaaacatcctctaccaccttgatgaaaagacaagccggttttcaatacttatagaggcttgggaacactgcaaaccccttgcatcaaatgagacccttcaagaagccctgtcagaggtgttgaacagcattaattcagctcaggtttacttcaaagcaggacttgatgtgttcaagagtgtcttggatgggaagaattgagaaaactctgagcatttttaaaagtttgtttacaattccacaagcaaaagctctaatttaaccagattttctgacattgaaggcttattttccccaatggctttttgacaagtataaagctattattacattgtattttttaaatgtaaatatagaaagaacattttgcacatttaatatttttcttatatctacatttctgaatatgtaaagcaagttattgaaataggacttaagaattacctattaaaaagaaatctgatatataaaaatatgtactattttaaggaaaaatttccaagaagttctggactatctttgttcctatggggagggcatataggaacacagtttattctctctgatagagctattaatgacttagtttctgtaaaagaaatggagagttgatatggttcagattaacttcactattaagtgttcaatatgaagaattcaagtattctgactgagtgattggttgacctaaaccactttgaatgtttctattttatgaaatgaagtttctcttcttaacacaactagatgtagtaatacactggttatgaaattgtatttttttaagtattaatgaaaaaaaccataagcattccaggagaaaatctaaggggcaagggagctacatagagcaatttaaatgcaaatttttttcctaacaacttacaaggtgactagctttgaaacccctaatttgcctcagttgattttctaagaatttcaggagtgatgtatgtcttaagagggagaaaaaaatatttcttattactttttctcttgtttctgttggaaacactgaagcagggactctaaaatgaaagcatctcacattggttttctttcttgtatcttttctgaaactccttgctgtaaggcagctttctcagagtactatatattttcaacagtaaagtagcagagtttctctttgaaacccaaaatgtcttctaaagaatcaaatttctatttctgcctctgacaaaaagaacttactatgaaagaaatagttgttttatcaataaaagccccttaatattatgaagaaacttttcatattttttcttctttatccttaattgtgactaagatggaaatctagaaaatattcatgcttctaagtttctgcaggttactgtaagagagtgtctcgtctacacttcagttcttctctcatgtggaaaactaagctttttatattgacattgccattgaatagctctagcaactattattattcccccaaaccctaaaattctacctattaggtgtcaggttaaagttctaatttatctttagaaatttatgtgaaaaatggttttcctatactggataaagcaattccccttaggaaacatagcctcagagtatttcatataaattttctctatctaattcaaacatatctccccatgatacaccgccagagtgacattgcagacagtctgtgtatgtttaaattttcactttttatggatgagcataaacctagtcttagtttaaaggcaaactaaagttgaggggaaataattaatcaatactgattaattgatttataaggttcaacactgtctaccctaaataatttttatatgctcaaggcaaagcagggaatagaggcaattagctagataattcaagcagaaatccattttcatcgaaattgcctgtgtgcacatatttttagatgaaaaatgaaactaccttacaatattatttttttaaccaatgtatttgtttgcaaacatttgccatgttgaagagtgtgtataggaaaggtctagaaataacataggcttgtgcatacctaggcattcatgctctttcttcctcttcagagatcatcagaaaagaggtgggaatacacaagcaggtgcatgtaagcccaaaagctagaaagccttatatttaaccaaaggttgatgtgttcattccagttattcacttacagatgaaactaaaacaaataaaggcaagctattatca

SEQ ID NO: 29371 - DNA, 2253 bp, Homo sapiens
acaatccaaacaatactgaatatacacataaacccaccacaaacacacaacctaaacatcctctaccaccttgatgaaaagacaagccggttttcaatacttatagaggcttgggaacactgcaaaccccttgcatcaaatgagacccttcaagaagccctgtcagaggtgttgaacagcattaattcagctcaggtttacttcaaagcaggacttgatgtgttcaagagtgtcttggatgggaagaattgagaaaactctgagcatttttaaaagtttgtttacaattccacaagcaaaagctctaatttaaccagattttctgacattgaaggcttattttccccaatggctttttgacaagtataaagctattattacattgtattttttaaatgtaaatatagaaagaacattttgcacatttaatatttttcttatatctacatttctgaatatgtaaagcaagttattgaaataggacttaagaattacctattaaaaagaaatctgatatataaaaatatgtactattttaaggaaaaatttccaagaagttctggactatctttgttcctatggggagggcatataggaacacagtttattctctctgatagagctattaatgacttagtttctgtaaaagaaatggagagttgatatggttcagattaacttcactattaagtgttcaatatgaagaattcaagtattctgactgagtgattggttgacctaaaccactttgaatgtttctattttatgaaatgaagtttctcttcttaacacaactagatgtagtaatacactggttatgaaattgtatttttttaagtattaatgaaaaaaaccataagcattccaggagaaaatctaaggggcaagggagctacatagagcaatttaaatgcaaatttttttcctaacaacttacaaggtgactagctttgaaacccctaatttgcctcagttgattttctaagaatttcaggagtgatgtatgtcttaagagggagaaaaaaatatttcttattactttttctcttgtttctgttggaaacactgaagcagggactctaaaatgaaagcatctcacattggttttctttcttgtatcttttctgaaactccttgctgtaaggcagctttctcagagtactatatattttcaacagtaaagtagcagagtttctctttgaaacccaaaatgtcttctaaagaatcaaatttctatttctgcctctgacaaaaagaacttactatgaaagaaatagttgttttatcaataaaagccccttaatattatgaagaaacttttcatattttttcttctttatccttaattgtgactaagatggaaatctagaaaatattcatgcttctaagtttctgcaggttactgtaagagagtgtctcgtctacacttcagttcttctctcatgtggaaaactaagctttttatattgacattgccattgaatagctctagcaactattattattcccccaaaccctaaaattctacctattaggtgtcaggttaaagttctaatttatctttagaaatttatgtgaaaaatggttttcctatactggataaagcaattccccttaggaaacatagcctcagagtatttcatataaattttctctatctaattcaaacatatctccccatgatacaccgccagagtgacattgcagacagtctgtgtatgtttaaattttcactttttatggatgagcataaacctagtcttagtttaaaggcaaactaaagttgaggggaaataattaatcaatactgattaattgatttataaggttcaacactgtctaccctaaataatttttatatgctcaaggcaaagcagggaatagaggcaattagctagataattcaagcagaaatccattttcatcgaaattgcctgtgtgcacatatttttagatgaaaaatgaaactaccttacaatattatttttttaaccaatgtatttgtttgcaaacatttgccatgttgaagagtgtgtataggaaaggtctagaaataacataggcttgtgcatacctaggcattcatgctctttcttcctcttcagagatcatcagaaaagaggtgggaatacacaagcaggtgcatgtaagcccaaaagctagaaagccttatatttaaccaaaggttgatgtgttcattccagttattcacttacagatgaaactaaaacaaataaaggcaagctattatca

SEQ ID NO: 29372 - DNA, 754 bp, Homo sapiens
aggagaagtgattttgcaaattgccaacgaacctgttctgccctttaatgcacttgatatagctttagaagttcaaaacaaccttaaaggtgatcaacccaacactcatcaactgttagccatggcgtcacgcctgcgggagagtgctgaactttttcagtctgatgagatgcgacctgctaatgatcccaaggagagagcacccatccgcatccggatgctgaatgacattctccaagacatggagaaaagctttctggtaaagcaggcaccaccaggtttttatagaaacatcctctaccaccttgatgaaaagacaagccggttttcaatacttatagaggcttgggaacactgcaaaccccttgcatcaaatgagacccttcaagaagccctgtcagaggtgttgaacagcattaattcagctcaggtttacttcaaagcaggacttgatgtgttcaagagtgtcttggatgggaagaattgagaaaactctgagcatttttaaaagtttgtttacaattccacaagcaaaagctctaatttaaccagattttctgacattgaaggcttattttccccaatggctttttgacaagtataaagctattattacattgtattttttaaatgtaaatatagaaagaacattttgcacatttaatatttttcttatatctacatttctgaatatgtaaagcaagttattgaaataggacttaagaattacctattaaaaagaaatctgatatat

SEQ ID NO: 29373 - DNA, 824 bp, Homo sapiens
aacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgtaaagaaagaaaaaaatt

SEQ ID NO: 29374 - DNA, 507 bp, Homo sapiens
gccgcacacacagaggtcaagcgctctctcacagtacaaaataatcctgggtatctcaaaagccaaagagatctggtaactcaatgcagaagacagcagccctttagacctgagggtcttgggagctcatgactcttggggctccacaaggaaaacagaaaaccccaaataggggatgtgcaaggcacctttttctatgttcttcaaggggtctcagggctgctagaagtctcccctaggtttcttcatgtggtatcaaagatggcaaaaggaaggagtcttagaagagcaaatttggggaaattttaagttttctaaaaggtaaatgaaattctgcatttttctcagcaaaaatcatgtcaacatgtggtggctcaagcctgtaatcccacctttggcttattaataatgaggacttgcttatttgtaagtcagtttggtaccaagtagacagtataccaacagacatgtatacacatgtattaatacaaatacaaacaaacataa

SEQ ID NO: 29375 - DNA, 711 bp, Homo sapiens
atgacgggttatgaagcccggctcattacttttgggacatggatgtactccgttaacaaagagcagcttgcaagagctggattttatgctataggtcaagaggataaagtacagtgctttcactgtggaggagggctagccaactggaagcccaaggaagatccttgggaacagcatgctaaatggtatccaggttgcaaatatctgctagaagagaagggacatgaatatataaacaacattcatttaacccgttcacttgagggagctctggtacaaactaccaagaaaacaccatcactaactaaaagaatcagtgataccatcttccctaatcctatgctacaagaagctatacgaatgggatttgatttcaaggacgttaagaaaataatggaggaaagaattcaaacatctgggagcaactataaaacgcttgaggttcttgttgcagatctagtgagcgctcagaaagacactacagaaaatgaattgaatcagacttcattgcagagagaaatcagccctgaagagccgctaaggcgtctgcaagaggagaagctttgtaaaatctgcatggacagacatatcgctgttgtttttattccttgtggacatctggtcacttgtaaacaatgtgctgaagcagttgacagatgtcccatgtgcagcgcggttattgatttcaagcaaagagtttttatgtcttaa

SEQ ID NO: 29376 - DNA, 1906 bp, Homo sapiens
gtctcttccgggtgcagatagctggaagggaaagaaaatccctaaaattacccacaagccaagaatgaagtgtctccctttgagccacagtggcagttttgtttttaatcatagaagtgtattttgagccgggtgtgctggctcacgcctgtaatccccgcactttgggaggccgaggtggggggcggagggggtggggatcgcctgaggtcaggagttcgagaccagcctgaccaacatggagaaaccccgtctctactaaaaatacaaaattagccggcgtggtggtgcatgcctgtaatcccagctactcatgaggctgagtcaggagaatctcttgaacccaggaggtggaggttgcggtgagctgagatcatgccattgcactccagcctgggaacaagaaaaaaaaaaaagaagaagaagaagtgtattcatttcagttacttttaaaaaagtgaacagactttatattttagagcggttttaggtttacagaaaatgaaacagacagggcagcgagctccttgtactcctccccagcacacagttgccctgttatgaacatcccacatcagtgctgtgcgttcattaacaccgatgaacctgatgcatacattatgatgaactgaagtcctggacttcaccctttctcttgtacagttctgtgggatttgacaaatgcataatgctgtacagccacaatgatagtatcgtccagagtagttctcctgccttaaaacctcttttgctgcacctgtttctctctccccactcaccccagctatctgatcttcttagtgcctccgaagttttggtcttttcaggatgttgtagcgttggaatcatggagtatgtagccttcaccacatacaccttccttcactttgttggcttcctttacttagtaatatgcattcaagtttcctccatgccttttcatggcttgatagctcatttctttttagcaccaaataatattccgttgtccagatgtagcacaatgtttaaccattcatgtaacctgtgaccgactcacagataggatgtggaatcactcaccacagaggcattagacaataatcagacccaagtcatttcatgggggaacaagcccacaggtaccagactgtccagtgagtcagggccactcgtaggaagtaagaagagaggctagagcatagccaggtcctcactttatactttaagcccatgtgtatttctcccaaaccacacagcattgtttccatgctttcagctttgcatgaataacgtgatacttgaacgcatcatttatcacttgctctctttcccacagcgctgttttcaagcttcttcctgttcatgatgctctgcttaacccttaagctgcatgggattctgttctgtgaatacgcccaccccatgtattatcctgcccagcaaaaagtccccaaaactctggatggtggttacctctagggagggagagaagagattgggaatagggagcgacttcaacggtgtttgtaatgttttgtttctttaaataaaagagctgagatcatttcagcagaatgttgatttagagtctcctggacaatttgttgctcaaagtgctctcttaaagagcactttaaaaaaaaaaaccttttatcttattatttatttatttatttattgagacggagttttgctctgtcacccaggctggagtggagtggtgtgatctcagctcactgcaacctttacctcctgggttcaagcaattcccctgcctcagcctcccaagtaggtgggattacagatgcgtgccaccacacttggctaatttttgcattttagtagagatcggtttctccatgttggccaggctgatctcaaacgcctgacctcaggtgatctgcccgccttggcctcccaaagt

SEQ ID NO: 29377 - DNA, 463 bp, Homo sapiens
atttatttatttatttatttatttatttatttgagagagagagagagagagtctcactgttgcccaggggtgtgtggcgcaatcacagttcagtgtaacctcaaactcctaggctcaagcgatcctcctgccttggcctcccaaagtgctgggattatagacatgagccactgtgcctggccaatgatgttggtaacattttttgagccctgtctagaacttgccatggtcatggggtcttatcacacatggtatttaatacttaaagatgtaaaataaaatagacttgaattaaagcaaaggaaaagaaactaaagcaagatagaaatgctgacttcattgcaagagagattagcgctatcttttagaaactaaatttatgacaagatgataaataataaatactaagagattagaataatttcttataaactatgagtttgtgagactctctcctttgaaa

SEQ ID NO: 29378 - DNA, 496 bp, Homo sapiens
gtttatcattcaaagtaacctctattctctatttcattagatcgcccatttttaacatgtgtaatttaatttaaaaatcacacaatactagcccagtccattcaaaaggctttttgaaaacctctgtttcctttgaaaatggattgttatctatggccataccaccctgaacaaacccgacctcatgtgaaaatggattgtagtttaggttcctccatttcaaagtggaattgcaagacctccctaacgtgtttacaacattcctgtgctgagtgttatcccttctcccaggagccagattgacagtctctagcgcagccctctctttggctgacagctgtcattcataatggcaagggggcagtcctatccccatctaaaataggcaacagaatgtagccagatcgcctactgtcatacctatactaaaacacacacaaacacacacacacacacacacacacacacacaaagatattcacggtagtgttttttt

SEQ ID NO: 29379 - DNA, 274 bp, Homo sapiens
ccccacctgtccttggctgcccatcccaaggaaagcaggtggcatgtgctggaatttctgctgttgctttcctcagaagcattgcaaaatatcatcagcttatactaactaccgactagtgattgagtgtgcagacccaaaatcaagccacctgagttttggacctgtttccatcacttgctagcagttttattacggttaagttatttaacttctctgcaactcagtttctcatctgaaaaattaagtaaataaatagcatctccttgctgga

SEQ ID NO: 29380 - DNA, 3178 bp, Homo sapiens
agtcacacagcagccttgtaggtgactggaggtgttcgctgatgtggccccaaccctacctccctccccaccccatgatgttagaagaatctcgacagaataaattggcagcagccaagaaaaagctaaaagaatatcagcaaaggaagagccctggtattccagcaggagcaaagacaaaaaagaaaaaaactgacagtagccctgagacaaccacttccggtggttgccactcacctggggatagccagtaccaagaactagcagtagccctggagtcaagctcagtgacaatcaatcagctcaatgaaaacatagaatcattgaaacagcagaagaaacaagtggaacatcagctggaagaagcaaagaaaacaaacaatgaaatacacaaagcacaaatggagcagttagagacaatcaacatcctcacattggaaaaggcagacttgaagaccaccctttaccatactaaacgtgctgcccgacacttcgaagaagagtccaaggatctggctggccgcctgcaatactccttacagcgtattcaagaattggagcgggctctctgtgctgtgtctacacagcagcaggaagaggacaggtcctcgagctgcagagaagcggtcctccagcggcggttacagcagaccataaaggagcgggcgctgctgaacgcacacgtgacacaggtgacagagtcactaaaacaagtccagctagagcgagacgaatatgctaaacacataaaaggagagagggcccggtggcaggagaggatgtggaaaatgtcggtggaggctcgaacattgaaggaagagaagaagcgtgacatacatcggatacaggagctggagaggagcttgtccgaactcaaaaaccagatggctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctgaacaacgagaaaaagagcgcactgcagttggagcagcaagtaaaggagctgcaggagaagctagacgaggagcacctagaagctgccagccaccagaaccaacagctagagacccagctaagcctcgtggctctccctggagaaggagatggaggacaacatctggacagtgaggaggaggaggcgcctcggcccacgccaaacatcccagaggacctggagagccgggaggccacgagcagctttatggacctcccgaaggagaaggcggacgggacggagcaggtggagagacgagagcttggattcgtccagccttctggagtgacagacggcatgagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgttttttatgaagtgagcctggacaacaacgtggagcctgcaccaggagcggccagggagggttctccccatgacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgtactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacacaaaagggcactggttggcattc

SEQ ID NO: 29381 - DNA, 460 bp, Homo sapiens
atttctatttattgactcatggatttccatagagttaagaagtaaatttttttaggaacttaaagaatgctgcattttgttttcactttgagttagatgtgaatttgctttagttattccatctgcaaagtatttgccatttcattgcaaagatttctgaattcattgtacaaacttgaaagtgtccatgttatttatacttctgctagagatctagcaattctgctagaatcaataggttttgaagggttttgtgatttatttcactctgctatcagccagctttttctatgaggcttaggtcacagaacctctttagaggtgaagtaagtaaacctctggttatcatccagtttgatctcaactctcaatgttcgaatgagtaaatgtatacagcttttattaaagtttttatatgtgtatgcactaaataaacagtgacaggaaaatttactctgag

SEQ ID NO: 29382 - DNA, 463 bp, Homo sapiens
aaaaatatcataagtccattttacaaacacaaaaatgtgataaagatgtgggacaatgccccttttttaaatattggacagttataaatagaaacgacatgcatatatgaatgtttacattttgttcataacaagaaatcaggaacagcttaatatgcaacagtagagaaatggctaaataaatcatgacatgttcatctgcaaaaaaaaaaaaatactatactgccagtattagggagttcttgcattgctatacagaaatatctgaggctgggtaatttataaagaaaagaggtttagttggctcaaggttctgcagacaggacaaaaagtgaggtgccaacatccgcttctggaaagggtcttaggaagctaacaatcacggcagaaggtgaagggaaagcaggcaccatgcatgatgagagtggaagcaaaagaacaagggggaggtgccacacacttt

SEQ ID NO: 29383 - DNA, 824 bp, Homo sapiens
aatcaggagtcaagtgaaacctttgcagatgaaagccatgagccccaaagatatggcatgctttatgtgaagaggatggtactagccagctgtcatgatggctgtgcaagcctccttatttgtttttttccttattgaggtcctttatctttaaacatctgtaggaagaagtatgattagctctctttgcctaattctgccagtagctactttgagaatttcaagcacaataacttcgcaaacttcaactcaacaaaaatttaccagcagcctttctgagaattattggggtttggacagtaattatgaatggacaaatcctacttttactcatgatgtccttttcccagtcctttccttttgctcacagtgtgtctgttctgtggggcatagactcagtaggaattgttccctttaagataccatttaccccaattatggtgcagtgatgatgatctgctttgcatatttcaggttctttttggctttttccattgaagccagtggtcctcccagcgttttatctttgatgtgacttttcattgataaagtaacactttaccttcctgggacaacagattccaacaccttaactaatctgaagttgttagcttccaccttccctcgtcacatgggacctttagggccaatttattttcctgcccacatgagaagtctccagtaaactagctgaaggtcctcagcatgtagcatgctttgtctctccagtgtttaaaagaaatcatcacattcacatgagcataccctctgcaccaccctccctttataactaccaccatatccacttcccttgctgcctctgc

SEQ ID NO: 29384 - DNA, 853 bp, Homo sapiens
caagaagtagcaattgggaattatgggctatacccagccttcaccctggtttttctagctcacgggcgcagctgttcccctacttatgaaaacaaaacttgcctgtaaacgtcttcatgtgcagtttcttaatgagccacaaggtgaggatgtggctccgtaagatctctgtctcagcaagatttgtcactcttctctttgtccctccaccagtcttctctctcttctgctttgtggcttaactgtttgatcacttattccccagttggctcataaacagcttgggctctggagttgggcagtcctggacttgtctcactcagaggcttcgtttccccatctgtgacgtgaggattaaagaccctggctcccgtgggaactggccctcacatgtgctggtggagtgtagagtgataccactcagcagagggccacttggcagtgtgtgcaaaagcacccttcgcctcagcagctctacttctgcaatttatgctgaggatgtgccagcacaaatgtgtgtgcatagtgactcatcatagcattgtttggactagcaaaaaagactagaaataacccaaatgtccactaataagggactggtgaaataaactagtgcgtccttacaccagaatacagtactggtcagtaatgaaaaagaggaagctgtctttgtacgttaagtcctcacttgatgtcgtcagtaagttcttggaaaccgtgactctgccacttgaaaggacatataacgaaaccaattttaccatagtctaattgatataaataagagttaagctcctatggcatatttctggtcatgaaagcatcaccaaacttctaagtaaagactaaaaca

SEQ ID NO: 29385 - DNA, 429 bp, Homo sapiens
tgaagaaatttcaggtcattagcggagttagcatattctatcttttaatttctacactacttcaaaggtcttctaactgttccattttctacaaagcatcccacacaatgtgctcatatcagtctttctaacacaaagagtgctcaaaagccaactgcctgctgttttttatttaatttttttcagtgacaggtcttgttctgtagcccatgctggagtgcccaggcaaaactcaatgcagcctcaaactcctgggcttaaacaatcctccagtttcagcttcctgagtagctgggactacaggtgtgtgccagcatgctcaactactttttaaattgtttgtagagatgggagtctcgttatgtttcccaggctggtcttgaactcctggcctcaagtaatccttctgtcacagcctcccaaagtgtt

SEQ ID NO: 29386 - DNA, 345 bp, Homo sapiens
gtttgtattttaatatagaatctgaaaatgacagttcttatatgaacttcagatgccataacaccaaagtgggaaatatattggtgagcagagggagtgtgctgccaagcaagtcacactgtaggggcagctgctgcccattttactcacacataaggccagtcttgccagaaatctgttaaatttaaaacacaggctgttgagatattctagtatatgtaatttaaagtcagacactttatttctgaaatgtcttcaataaccattattttcttatattgctcctttggagggtggaggacaactttgccagaaaggtacattatcaatgtttccagtgatttg

SEQ ID NO: 29387 - DNA, 548 bp, Homo sapiens
ttcttcatagccacctttggatttgtgagccctcacatcaggatctactaacagtttatgtccatgctgcagatataaaggatgaagttgtagggcaggaagtcttatgacacttggagcagctactcaatggaaatcacaaacagaatgagtttcatccacatgtcaagacactactaccaacagagctatttcaggacacctacctaaataactagctgtctcttccacttaaagcaaggagagtcttctcttatcttcaagaagaataaaaagtgaagctgacattacttggaaagagaataaacaaaatctgtcatgaggactgcagggatgaatgacacaaaccagccatttctttgagagtcaggaaatatctagtttatacaataagctgatctaccaataaaatacaattggtgttgaaatatatggctgaggaaagtcctcatgtttcaaggttcaaagttattccaaagaagtcctcgctctacaaatgtaacattgagatgacgtattatatgcttatcagaataaactaaaggaac

SEQ ID NO: 29388 - DNA, 386 bp, Homo sapiens
tagcagaaagaagagcaaggagaagttggtgaagctggggcaaagtgaggatatgtgtgcgtgcagtttatgtccatgctgcagatataaaggatgaagttgtagggcaggaagtcttatgacacttggagcagctactcaatggaaatcacaaacagaatgagtttcatccacatgtcaagacactactaccaacagagctatttcaggacacctacctaaataactagctgtctcttccacttaaagcaagagcgtataatggagttaggatgactggatacacatgtaagtcatcatctttacgtgcttattgtcacttggatctggcaggttgactattgaatagtacccgactggcactaataaaattgctaaactgctgt

SEQ ID NO: 29389 - DNA, 303 bp, Homo sapiens
ttcaattccattcgatgatgattccatttgattccattcgatgatgattccattcagttacattggatgatgaatccattcaattccattcgatgatcattccattctatttcattcgatgatgattccattcaatttcattcgatgattccattcgatcccattcgatgatgactccattctattccattggatgattccattctattccattcgatgatgatcccattcaattccattcaatgatgattccattcgattccatttgatgatgattccatacgatgatgattccatttgatt

SEQ ID NO: 29390 - DNA, 461 bp, Homo sapiens
gtaatcctaacactttgggagggcaaggcaggtggatcacttgaggtcaggagttcgagaccagccttgccacatggtgaaaccctgtctctatgaaaaatacaaaaaatagctgggcatcgtggcaggtgcctgtaatcccagctacgtgggagactgaggcaggagaatctcttgaacccaggaggtggaggttgcagtgtgttgagatcgcccctggactctagcagcaacagagacagactccatctcaaacaaaaaaaaaaggaggctcacccttagaaaggcttctacaaattaacaccacaaagtggacacaggcacacagatcttggtaaatgtgggctatcattacttaacgatgatttcaccagcctctttcagcctcaggatgagctccattcccgtttccaggtattagagtcaaacctacccccacctcccaccagagccccggctta

SEQ ID NO: 29391 - DNA, 632 bp, Homo sapiens
gcccgcgcgcaggggttgcgaacaggatgaaagtcagaggaaacagaagtgagctagcctagcccaagaggggccccaaacatgcatgcacctcacatcacgaaacgaatcatgagaagcacttcaagtgtgaatagggacaggctggaatcccagggaaaccgtgcatgacaggatctggcaaggtccctagtacccagcagtgcctccaaaactttcctttaaaaagaaacacctctagggaagcctgtttcaggttctaagaaagcagtgtttaggatttcatgggaggaccacaacatgccccgaaaaaaacaggctgttccgcagtcagtgaaacttactagggatcttacaaactgtctttcagtttgagctttaaattaatgagctctcaaatccccagtgggcatctggccccccgaccctcatactacttttgattcttatgtttcagaggcctttgcttgaatggaaaatcttttccccaaatttttgtactattaatatcaatacaattcaatcctgtgtacaacagaaaaaaagttgggggaggtcaagataaacaaatcctcattgcagccaaaaccttaaaaagttgtgtgatcttctgtgccttggtcaaatgtagg

SEQ ID NO: 29392 - DNA, 338 bp, Homo sapiens
gaagaataaaataataataactgaaggatgagataaaagccctacctaaaattattttggttgaacagtagcaaatgttagagtatgttccactggctacattattctctgaagtaagttgatattttgccttcttccaaggatatgtgtatagtagactctcctatgccactgaaattttcagtatttaccttaaaattttttgtaattttaagttaactatattatgaatttttgcttttccacttttcctaagacttcttagatactatacaattgcacatggtatatattgggcaaaactataaataaaaattaaatcctgtccttataacagc

SEQ ID NO: 29393 - DNA, 484 bp, Homo sapiens
taaatacttaacatcaacactgatctttaaatgctttagcacaatcaaatataaataacaaacacacacataaatgcaaaataaatgaattagggagatagatgaaataagattgtggaaatagtaatgtttgttaaagctggatggtgatccttgtactattcactctactctagtgtgtatttgaaaattaccattaggctggttatggtggctcatgcctgttaatcccggcattttggaaggctgaggcaggcggattacttgagctcaggagtttgagatctgcctgggcaacatggcaaaatcccatctctacaaaaaattagctggcatgatggcacactcctgtagtcccagctccttgaggggctgaggcagagaatggcttgaacctgagaggtcaaagctgcagtgagccaagatcatgccactgcactccagcctgggtgaccaagtgagaccctgtctcaaaaaaaaaaaa

SEQ ID NO: 29394 - DNA, 472 bp, Homo sapiens
atccatttggggagaccaggttttttgttttgttttcatatttgaatctttgctgacttgctcctttaatatcagacacttaaatcctcaagaattgggacctcatcattaatttttttttggagatggaatctcactatgttgctcaagcttggtctcaaactcctgggctcaagccatcctctcgtcttgtgggcctcacaaaatgcctgttaatcccggcattttggaaggctgaggcaggcggattacttgagctcaggagtttgagatctgcctgggcaacatggcaaaatcccatctctacaaaaaattagctggcatgatggcacactcctgtagtcccagctccttgaggggctgaggcagagaatggcttgaacctgagaggtcaaagctgcagtgagccaagatcatgccactgcactccagcctgggtgaccaagtgagaccctgtctcaaaaaaaaaaaa

SEQ ID NO: 29395 - DNA, 5907 bp, Homo sapiens
gcgggtagccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctggagacagcggcagagcacgagcggatcctgcgagagatcgagagcactgacacggcctgcatcgggcccacgctcaggtctgtttatgatggtgaagaacatggacgtttcatggagaagcttgaaactcgtatccgtaatcacgaccgagaaattgagaaaatgtgcaactttcattaccagggctttgtggactctataactgaactgctgaaagtgagaggagaagcccagaaactcaaactggtaatagcaatggaagagctgaagcagtgtcgactacaacagagaaatatttctgccactgttgataaattaatgctgtgtcttccagtcctagagatgtacagcaaactgagggaccagatgaaaactaaaaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagcccagcagcaaagaaacctggataacatcgtcttgcaacaacccagaataggtagcaagaggaaatctaagaaagatgcatatataatctttgatacagagatagaaagtactagtccgaagtctgaacaggattcaggaattctggatgttgaagacgaggaagatgatgaagaggtacctggggcccaagatttggtggatttctctccagtttatcgatgtctacatatatattctgtcctgggtgcccgggaaacatttgagaattactaccgaaaacagaggcgaaaacaggctcgtttggtacttcaacctccatctaacatgcatgaaactttagatggctacaggaagtattttaatcaaattgtaggcttttttgtggttgaagatcacattttacatacaacccagggcttagtaaatagagcctacattgatgaactgtgggaaatggcactttcaaaaaccatcgcagcactccgtacccactcgtcttactgttctgatccaaaccttgtgttagatttgaagaacctcattgtgctttttgctgacacacttcaggtgtatggtttccctgtaaatcagctttttgacatgctgttagaaatcagagaccaatatagtgaaactctgctaaagaagtgggcaggtattttcagaaacatacttgattctgacaactacagtcctataccagtaacaagtgaagagatgtacaaaaaggtggtaggacaattcccatttcaagatatagaactggaaaagcaaccatttccaaaaaagtttcctttctctgaatttgtgccaaaagtttacaaccaaattaaagaatttatctacgcttgtctgaagttttcagaagatcttcatctaagctcaactgaagttgatgacatgattcggaaatcaacaaacctgttgctaaccaggactctgagcaactctctgcagaatgtaattaaaaggaagaatattgggcttactgagcttgttcagattattatcaatacaacacatttggagaaatcctgtaagtacttggaagaatttatcaccaacatcactaatgtgcttccagagacagttcacactaccaagctctatggcaccacaacttttaaggatgctagacatgcagctgaagaagagatttataccaacttaaaccagaagattgaccagttcctacagctggcagactatgactggatgaccggagatttgggcaacaaagctagtgattacctggtagacctcattgcctttcttcgtagcacctttgctgtattcacacaccttcctggaaaggtggcccagacagcgtgtatgtcagcttgcaagcatttagccacatccttgatgcaacttttgttggaagctgaagtgcggcagctcaccttgggagcattacagcagttcaacttggacgtcagagaatgtgaacagtttgccagatccggcccggtgcctgggttccaggaggacacgctgcagttggccttcatcgacttgagacaacttttggatcttttcatccagtgggattggtcaacctaccttgctgactatggtcagcccaactgcaagtacctccgggtaaacccagtgactgctctgaccctgcttgagaagatgaaggatactagccgcaagaacaacatgtttgcacagtttcggaaaaatgagcgagacaagcagaaactcattgacaccgtggccaagcagctccgaggactcatcagcagccaccactcatgaagggtgaccccggacccacagaggcgacctgctgcagcctctgtgtcagtctggggtccagccccagctgaccctgcatttgtgcattcttcttcaaagagagcatatgtatttttttattaacccctgtgcagtattcacataacatttccctatagtaaaagaggcacaagaataagcaagtacatgagatgttgctaggctgggactcaggggaagttattactacactatctgtgttatcttagagatggtggtatcatcaattccacagtgatgaaccacctttcatccatggctctaaagcttaggtctggggcttaggaaccataaaaagtgggtatctggcgctgggaggtagagtgagtaagcaaaaggatactaaaatatgtcctgttcactcttggatgcccattcaccacatagatgaggctgattcttctcaatacaaggaaagggcatggcaaacattactatttagtacactaagggcagctctggagggtcatctcctcagtctgctgactttcactggcttgtgaacaagcatggcatatggcaagatgacagcttcattccaatcccccaagaatggcggtttctttagcctgatctaaccccaggcttttattgcaattttttctagggcaggatacagctaagtagacagcagtaataattggatcccatgtttaactgcatattgccccagctctaggagtgttgagtctcaactcgaagagtttttctggatcttgaaagccagttttcatggaatcagagacccaatcccttccctgttcatctcatttccttcacttacagtcagagcacttggttcaggacataaatcaacagttacttccataggccttcacagggcgtttcagacttagcctcctccagtaatgccattgaaatagttcagatttcggaagcctaaaaatggcctttaccttacccttaggtgtaacctgaggattagttgggattgttcctttatgttttaaaaccagctttttggttatcatctttaaggaaatgtcaccagctctgcactgtgggggcagccatgcctggactggatgcctctagggatggagacattgttaccataaagtcgacagagccaaccatggcttgtggcttgttgcctctggcccaactgtccttcactaaataatatcctagatattattttgttgctcaagcccaaggttcccaccctcttttgagatccccaaagccatctttggccttgtctaagaaagattgcctataatcctgtcctccaaactctaaagcctggagcagcttagcgtggaggctgcactcattgacccagatggactcctgagacttaacgcaagggctttgctatgaggtcagtcgggggaaactgtactttaagacacttcagaaagatgctactggctagtagcagaaagatggctagtggcaagagtataattgtgcatcaccaaacaatgacaaataagccacacaggcatttccagcttggattgatgggaggagagactcatcaaacagaattcttcactacctttgtcagctactgagttgcttctggggagggaagtacttccttgcccctccccaacccccctacctcaccatatcctatcatatcttgatagtcatggggaagaggatgtgcacacagacatacaaatttcctcaaagctggagagaccaggctacatgtgagctcatagatgctgctgaggctcatcctgagggctggatggttggccagggtttcagaatgagggtaagggatgagcactgccacccagaacttgataagccaagagaaggcaggagccaaaatggcatcgccaagctctcatctttgttgaaacaagtgagaaacgattatattaatctgaagttctattgcttgagaagagttcaaaacacttctctttgctagtacccagtttgcagcaagatctcttcagctttaagtgctgagagactttgaagtggaaatggagagatgtgtaagcatggcacagtgtttgtctttttagaggatcatcattgctggtctggtctcaaacctctgccttggaagaactgtgctatacaggaaaaagtgaacaaggtggaggaataggggttattctgcacagaagtcccatgaaaggaaaagcttattcaagctcaagacataaagatggaccctttgatatatcttctctccattcttagtctgccttcaccttatctaacaaaaaacaacatgcagctactgagttgtatgtagagacatactcttggtgggccagggaaggtaaaaacagggaccagcaatgtcaagtttttgaactagaaaagtgggatgtttttagttttgtctataacctgtagctgggccaacccttgagaggacttgtgcaaagcatgtgtgcccagacccatcagactcctcagatatggcctcaaatacctagagatgtagaagtaccgtggagggcctcaataagagggcaagcacacagatggctagaagcctgtatggcttctggtcaggatgaacccttggccaagttcttgaggaaaccaggtctatattcctgaagggacagttcagtttgggactctattaggtttcagtagtaatataggctgcttgcatcattttaacattcatagggaaaatctctttgagcaggctataaatgaagctgttgcaggtagggaagaacaggacctgaaaatgggaaccaggaagtgagatcctgttggcaaagggaatgtagagcttccagggtgcattgcccactgttctcattgcataccagtcctccaagtcagtctagccttactgtacacttgacaagtgcttactcagcaagtcccagacccacggccttttatctcccaagactggctttggccatgaccttcctcatcaggcctctgagcacactctctaggaactgctgcagaaattcccctaccttagcctcccttctcccaggactcctctcttgactgcaattgcctcttcttcttcttcttcttcttcctttttgttttttttttttttgcctgcattcacaattacttttcacaaaggtgttggaaatggcatttttattttacacagatagttgcacatatatagagaaaattaggaaagtccatttttaactctaaagggaacttttttctctaaaacttacttgtaaagctactgatacagatgggccgcatggttaggggaaagctcctctgtgaaaagagcatgtttattcctcttgtacattttcctcttttaactgctattaaacaagaaagcctacatacctgtttcaaaagccacggtgttgtctcatgggtattttgttcttccatcctttttgcacagtgcagct

SEQ ID NO: 29396 - DNA, 5779 bp, Homo sapiens
  misc_feature (31)..(31): n is a, c, g, or t
gcctcgcctctaccttgtctgccggcgacgnccgggtatgggcccacgctcagtctgtttatgatggtgaagaacatggacgtttcatggagaagcttgaaactcgtatccgtaatcacgaccgagaaattgagaaaatgtgcaactttcattaccagggctttgtggactctataactgaactgctgaaagtgagaggagaagcccagaaactcaaaaatcaagtgacggatactaatagaaaactacaacatgagggaaaggaactggtaatagcaatggaagagctgaagcagtgtcgactacaacagagaaatatttctgccactgttgataaattaatgctgtgtcttccagtcctagagatgtacagcaaactgagggaccagatgaaaactaaaaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagcccagcagcaaagaaacctggataacatcgtcttgcaacaacccagaataggtagcaagaggaaatctaagaaagatgcatatataatctttgatacagagatagaaagtactagtccgaagtctgaacaggattcaggaattctggatgttgaagacgaggaagatgatgaagaggtacctggggcccaagatttggtggatttctctccagtttatcgatgtctacatatatattctgtcctgggtgcccgggaaacatttgagaattactaccgaaaacagaggcgaaaacaggctcgtttggtacttcaacctccatctaacatgcatgaaactttagatggctacaggaagtattttaatcaaattgtaggcttttttgtggttgaagatcacattttacatacaacccagggcttagtaaatagagcctacattgatgaactgtgggaaatggcactttcaaaaaccatcgcagcactccgtacccactcgtcttactgttctgatccaaaccttgtgttagatttgaagaacctcattgtgctttttgctgacacacttcaggtgtatggtttccctgtaaatcagctttttgacatgctgttagaaatcagagaccaatatagtgaaactctgctaaagaagtgggcaggtattttcagaaacatacttgattctgacaactacagtcctataccagtaacaagtgaagagatgtacaaaaaggtggtaggacaattcccatttcaagatatagaactggaaaagcaaccatttccaaaaaagtttcctttctctgaatttgtgccaaaagtttacaaccaaattaaagaatttatctacgcttgtctgaagttttcagaagatcttcatctaagctcaactgaagttgatgacatgattcggaaatcaacaaacctgttgctaaccaggactctgagcaactctctgcagaatgtaattaaaaggaagaatattgggcttactgagcttgttcagattattatcaatacaacacatttggagaaatcctgtaagtacttggaagaatttatcaccaacatcactaatgtgcttccagagacagttcacactaccaagctctatggcaccacaacttttaaggatgctagacatgcagctgaagaagagatttataccaacttaaaccagaagattgaccagttcctacagctggcagactatgactggatgaccggagatttgggcaacaaagctagtgattacctggtagacctcattgcctttcttcgtagcacctttgctgtattcacacaccttcctggaaaggtggcccagacagcgtgtatgtcagcttgcaagcatttagccacatccttgatgcaacttttgttggaagctgaagtgcggcagctcaccttgggagcattacagcagttcaacttggacgtcagagaatgtgaacagtttgccagatccggcccggtgcctgggttccaggaggacacgctgcagttggccttcatcgacttgagacaacttttggatcttttcatccagtgggattggtcaacctaccttgctgactatggtcagcccaactgcaagtacctccgggtaaacccagtgactgctctgaccctgcttgagaagatgaaggatactagccgcaagaacaacatgtttgcacagtttcggaaaaatgagcgagacaagcagaaactcattgacaccgtggccaagcagctccgaggactcatcagcagccaccactcatgaagggtgaccccggacccacagaggcgacctgctgcagcctctgtgtcagtctggggtccagccccagctgaccctgcatttgtgcattcttcttcaaagagagcatatgtatttttttattaacccctgtgcagtattcacataacatttccctatagtaaaagaggcacaagaataagcaagtacatgagatgttgctaggctgggactcaggggaagttattactacactatctgtgttatcttagagatggtggtatcatcaattccacagtgatgaaccacctttcatccatggctctaaagcttaggtctggggcttaggaaccataaaaagtgggtatctggcgctgggaggtagagtgagtaagcaaaaggatactaaaatatgtcctgttcactcttggatgcccattcaccacatagatgaggctgattcttctcaatacaaggaaagggcatggcaaacattactatttagtacactaagggcagctctggagggtcatctcctcagtctgctgactttcactggcttgtgaacaagcatggcatatggcaagatgacagcttcattccaatcccccaagaatggcggtttctttagcctgatctaaccccaggcttttattgcaattttttctagggcaggatacagctaagtagacagcagtaataattggatcccatgtttaactgcatattgccccagctctaggagtgttgagtctcaactcgaagagtttttctggatcttgaaagccagttttcatggaatcagagacccaatcccttccctgttcatctcatttccttcacttacagtcagagcacttggttcaggacataaatcaacagttacttccataggccttcacagggcgtttcagacttagcctcctccagtaatgccattgaaatagttcagatttcggaagcctaaaaatggcctttaccttacccttaggtgtaacctgaggattagttgggattgttcctttatgttttaaaaccagctttttggttatcatctttaaggaaatgtcaccagctctgcactgtgggggcagccatgcctggactggatgcctctagggatggagacattgttaccataaagtcgacagagccaaccatggcttgtggcttgttgcctctggcccaactgtccttcactaaataatatcctagatattattttgttgctcaagcccaaggttcccaccctcttttgagatccccaaagccatctttggccttgtctaagaaagattgcctataatcctgtcctccaaactctaaagcctggagcagcttagcgtggaggctgcactcattgacccagatggactcctgagacttaacgcaagggctttgctatgaggtcagtcgggggaaactgtactttaagacacttcagaaagatgctactggctagtagcagaaagatggctagtggcaagagtataattgtgcatcaccaaacaatgacaaataagccacacaggcatttccagcttggattgatgggaggagagactcatcaaacagaattcttcactacctttgtcagctactgagttgcttctggggagggaagtacttccttgcccctccccaacccccctacctcaccatatcctatcatatcttgatagtcatggggaagaggatgtgcacacagacatacaaatttcctcaaagctggagagaccaggctacatgtgagctcatagatgctgctgaggctcatcctgagggctggatggttggccagggtttcagaatgagggtaagggatgagcactgccacccagaacttgataagccaagagaaggcaggagccaaaatggcatcgccaagctctcatctttgttgaaacaagtgagaaacgattatattaatctgaagttctattgcttgagaagagttcaaaacacttctctttgctagtacccagtttgcagcaagatctcttcagctttaagtgctgagagactttgaagtggaaatggagagatgtgtaagcatggcacagtgtttgtctttttagaggatcatcattgctggtctggtctcaaacctctgccttggaagaactgtgctatacaggaaaaagtgaacaaggtggaggaataggggttattctgcacagaagtcccatgaaaggaaaagcttattcaagctcaagacataaagatggaccctttgatatatcttctctccattcttagtctgccttcaccttatctaacaaaaaacaacatgcagctactgagttgtatgtagagacatactcttggtgggccagggaaggtaaaaacagggaccagcaatgtcaagtttttgaactagaaaagtgggatgtttttagttttgtctataacctgtagctgggccaacccttgagaggacttgtgcaaagcatgtgtgcccagacccatcagactcctcagatatggcctcaaatacctagagatgtagaagtaccgtggagggcctcaataagagggcaagcacacagatggctagaagcctgtatggcttctggtcaggatgaacccttggccaagttcttgaggaaaccaggtctatattcctgaagggacagttcagtttgggactctattaggtttcagtagtaatataggctgcttgcatcattttaacattcatagggaaaatctctttgagcaggctataaatgaagctgttgcaggtagggaagaacaggacctgaaaatgggaaccaggaagtgagatcctgttggcaaagggaatgtagagcttccagggtgcattgcccactgttctcattgcataccagtcctccaagtcagtctagccttactgtacacttgacaagtgcttactcagcaagtcccagacccacggccttttatctcccaagactggctttggccatgaccttcctcatcaggcctctgagcacactctctaggaactgctgcagaaattcccctaccttagcctcccttctcccaggactcctctcttgactgcaattgcctcttcttcttcttcttcttcttcctttttgttttttttttttttgcctgcattcacaattacttttcacaaaggtgttggaaatggcatttttattttacacagatagttgcacatatatagagaaaattaggaaagtccatttttaactctaaagggaacttttttctctaaaacttacttgtaaagctactgatacagatgggccgcatggttaggggaaagctcctctgtgaaaagagcatgtttattcctcttgtacattttcctcttttaactgctattaaacaagaaagcctacatacctgtttcaaaagccacggtgttgtctcatgggtattttgttcttccatcctttttgcacagtgcagct

SEQ ID NO: 29397 - DNA, 5486 bp, Homo sapiens
gcgggtagccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctggagacagcggcagagcacgagcggatcctgcgagagatcgagagcactgacacggcctgcatcgggcccacgctcaggtctgtttatgatggtgaagaacatggacgtttcatggagaagcttgaaactcgtatccgtaatcacgaccgagaaattgagaaaatgtgcaactttcattaccagggctttgtggactctataactgaactgctgaaagtgagaggagaagcccagaaactcaaactggtaatagcaatggaagagctgaagcagtgtcgactacaacagagaaatatttctgccactgttgataaattaatgctgtgtcttccagtcctagagatgtacagcaaactgagggaccagatgaaaactaaaaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagcccagcagcaaagaaacctggataacatcgtcttgcaacaacccagaataggtagcaagaggaaatctaagaaagatgcatatataatctttgatacagagatagaaagtactagtccgaagtctgaacaggattcaggaattctggatgttgaagacgaggaagatgatgaagaggtacctggggcccaagatttggtggatttctctccagtttatcgatgtctacatatatattctgtcctgggtgcccgggaaacatttgagaattactaccgaaaacagaggcgaaaacaggctcgtttggtacttcaacctccatctaacatgcatgaaactttagatggctacaggaagtattttaatcaaattgtaggcttttttgtggttgaagatcacattttacatacaacccagggcttagtaaatagagcctacattgatgaactgtgggaaatggcactttcaaaaaccatcgcagcactccgtacccactcgtcttactgttctgatccaaaccttgtgttagatttgaagaacctcattgtgctttttgctgacacacttcaggtgtatggtttccctgtaaatcagctttttgacatgctgttagaaatcagagaccaatatagtgaaactctgctaaagaagtgggcaggtattttcagaaacatacttgattctgacaactacagtcctataccagtaacaagtgaagagatgtacaaaaaggtggtaggacaattcccatttcaagatatagaactggaaaagcaaccatttccaaaaaagtttcctttctctgaatttgtgccaaaagtttacaaccaaattaaagaatttatctacgcttgtctgaagttttcagaagatcttcatctaagctcaactgaagttgatgacatgattcggaaatcaacaaacctgttgctaaccaggactctgagcaactctctgcagaatgtaattaaaaggaagaatattgggcttactgagcttgttcagattattatcaatacaacacatttggagaaatcctgtaagtacttggaagaatttatcaccaacatcactaatgtgcttccagagacagttcacactaccaagctctatggcaccacaacttttaaggatgctagacatgcagctgaagaagagatttataccaacttaaaccagaagattgaccagttcctacagctggcagactatgactggatgaccggagatttgggcaacaaagctagtgattacctggtagacctcattgcctttcttcgtagcacctttgctgtattcacacaccttcctggaaaggtggcccagacagcgtgtatgtcagcttgcaagcatttagccacatccttgatgcaacttttgttggaagctgaagtgcggcagctcaccttgggagcattacagcagttcaacttggacgtcagagaatgtgaacagtttgccagatccggcccggtgcctgggttccaggaggacacgctgcagttggccttcatcgacttgagacaacttttggatcttttcatccagtgggattggtcaacctaccttgctgactatggtcagcccaactgcaagtacctccgggtaaacccagtgactgctctgaccctgcttgagaagatgaaggatactagccgcaagaacaacatgtttgcacagtttcggaaaaatgagcgagacaagcagaaactcattgacaccgtggccaagcagctccgaggactcatcagcagccaccactcatgaagggtgaccccggacccacagaggcgacctgctgcagcctctgtgtcagtctggggtccagccccagctgaccctgcatttgtgcattcttcttcaaagagagcatatgtatttttttattaacccctgtgcagtattcacataacatttccctatagtaaaagaggcacaagaataagcaagtacatgagatgttgctaggctgggactcaggggaagttattactacactatctgtgttatcttagagatggtggtatcatcaattccacagtgatgaaccacctttcatccatggctctaaagcttaggtctggggcttaggaaccataaaaagtgggtatctggcgctgggaggtagagtgagtaagcaaaaggatactaaaatatgtcctgttcactcttggatgcccattcaccacatagatgaggctgattcttctcaatacaaggaaagggcatggcaaacattactatttagtacactaagggcagctctggagggtcatctcctcagtctgctgactttcactggcttgtgaacaagcatggcatatggcaagatgacagcttcattccaatcccccaagaatggcggtttctttagcctgatctaaccccaggcttttattgcaattttttctagggcaggatacagctaagtagacagcagtaataattggatcccatgtttaactgcatattgccccagctctaggagtgttgagtctcaactcgaagagtttttctggatcttgaaagccagttttcatggaatcagagacccaatcccttccctgttcatctcatttccttcacttacagtcagagcacttggttcaggacataaatcaacagttacttccataggccttcacagggcgtttcagacttagcctcctccagtaatgccattgaaatagttcagatttcggaagcctaaaaatggcctttaccttacccttaggtgtaacctgaggattagttgggattgttcctttatgttttaaaaccagctttttggttatcatctttaaggaaatgtcaccagctctgcactgtgggggcagccatgcctggactggatgcctctagggatggagacattgttaccataaagtcgacagagccaaccatggcttgtggcttgttgcctctggcccaactgtccttcactaaataatatcctagatattattttgttgctcaagcccaaggttcccaccctcttttgagatccccaaagccatctttggccttgtctaagaaagattgcctataatcctgtcctccaaactctaaagcctggagcagcttagcgtggaggctgcactcattgacccagatggactcctgagacttaacgcaagggctttgctatgaggtcagtcgggggaaactgtactttaagacacttcagaaagatgctactggctagtagcagaaagatggctagtggcaagagtataattgtgcatcaccaaacaatgacaaataagccacacaggcatttccagcttggattgatgggaggagagactcatcaaacagaattcttcactacctttgtcagctactgagttgcttctggggagggaagtacttccttgcccctccccaacccccctacctcaccatatcctatcatatcttgatagtcatggggaagaggatgtgcacacagacatacaaatttcctcaaagctggagagaccaggctacatgtgagctcatagatgctgctgaggctcatcctgagggctggatggttggccagggtttcagaatgagggtaagggatgagcactgccacccagaacttgataagccaagagaaggcaggagccaaaatggcatcgccaagctctcatctttgttgaaacaagtgagaaacgattatattaatctgaagttctattgcttgagaagagttcaaaacacttctctttgctagtacccagtttgcagcaagatctcttcagctttaagtgctgagagactttgaagtggaaatggagagatgtgtaagcatggcacagtgtttgtctttttagaggatcatcattgctggtctggtctcaaacctctgccttggaagaactgtgctatacaggaaaaagtgaacaaggtggaggaataggggttattctgcacagaagtcccatgaaaggaaaagcttattcaagctcaagacataaagatggaccctttgatatatcttctctccattcttagtctgccttcaccttatctaacaaaaaacaacatgcagctactgagttgtatgtagagacatactcttggtgggccagggaaggtaaaaacagggaccagcaatgtcaagtttttgaactagaaaagtgggatgtttttagttttgtctataacctgtagctgggccaacccttgagaggacttgtgcaaagcatgtgtgcccagacccatcagactcctcagatatggcctcaaatacctagagatgtagaagtaccgtggagggcctcaataagagggcaagcacacagatggctagaagcctgtatggcttctggtcaggatgaacccttggccaagttcttgaggaaaccaggtctatattcctgaagggacagttcagtttgggactctattaggtttcagtagtaatataggctgcttgcatcattttaacattcatagggaaaatctctttgagcaggctataaatgaagctgttgcaggtagggaagaacaggacctgaaaatgggaaccaggaagtgagatcctgttggcaaagggaatgtagagcttccagggtgcattgcccactgttctcattgcataccagtcctccaagtcagtctagccttactgtacacttgacaagtgcttactcagcaagtcccagactgatactgtcccttcaggaataatagacctggtttctctcaagaacttgtccatagggtttatctcttaccagaagcctatacaggcttctga

SEQ ID NO: 29398 - DNA, 3310 bp, Homo sapiens
gcgggtagccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctggagacagcggcagagcacgagcggatcctgcgagagatcgagagcactgacacggcctgcatcgggcccacgctcaggtctgtttatgatggtgaagaacatggacgtttcatggagaagcttgaaactcgtatccgtaatcacgaccgagaaattgagaaaatgtgcaactttcattaccagggctttgtggactctataactgaactgctgaaagtgagaggagaagcccagaaactcaaactggtaatagcaatggaagagctgaagcagtgtcgactacaacagagaaatatttctgccactgttgataaattaatgctgtgtcttccagtcctagagatgtacagcaaactgagggaccagatgaaaactaaaaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagcccagcagcaaagaaacctggataacatcgtcttgcaacaacccagaataggtagcaagaggaaatctaagaaagatgcatatataatctttgatacagagatagaaagtactagtccgaagtctgaacaggattcaggaattctggatgttgaagacgaggaagatgatgaagaggtacctggggcccaagatttggtggatttctctccagtttatcgatgtctacatatatattctgtcctgggtgcccgggaaacatttgagaattactaccgaaaacagaggcgaaaacaggctcgtttggtacttcaacctccatctaacatgcatgaaactttagatggctacaggaagtattttaatcaaattgtaggcttttttgtggttgaagatcacattttacatacaacccagggcttagtaaatagagcctacattgatgaactgtgggaaatggcactttcaaaaaccatcgcagcactccgtacccactcgtcttactgttctgatccaaaccttgtgttagatttgaagaacctcattgtgctttttgctgacacacttcaggtgtatggtttccctgtaaatcagctttttgacatgctgttagaaatcagagaccaatatagtgaaactctgctaaagaagtgggcaggtattttcagaaacatacttgattctgacaactacagtcctataccagtaacaagtgaagagatgtacaaaaaggtggtaggacaattcccatttcaagatatagaactggaaaagcaaccatttccaaaaaagtttcctttctctgaatttgtgccaaaagtttacaaccaaattaaagaatttatctacgcttgtctgaagttttcagaagatcttcatctaagctcaactgaagttgatgacatgattcggaaatcaacaaacctgttgctaaccaggactctgagcaactctctgcagaatgtaattaaaaggaagaatattgggcttactgagcttgttcagattattatcaatacaacacatttggagaaatcctgtaagtacttggaagaatttatcaccaacatcactaatgtgcttccagagacagttcacactaccaagctctatggcaccacaacttttaaggatgctagacatgcagctgaagaagagatttataccaacttaaaccagaagattgaccagttcctacagctggcagactatgactggatgaccggagatttgggcaacaaagctagtgattacctggtagacctcattgcctttcttcgtagcacctttgctgtattcacacaccttcctggaaaggtggcccagacagcgtgtatgtcagcttgcaagcatttagccacatccttgatgcaacttttgttggaagctgaagtgcggcagctcaccttgggagcattacagcagttcaacttggacgtcagagaatgtgaacagtttgccagatccggcccggtgcctgggttccaggaggacacgctgcagttggccttcatcgacttgagacaacttttggatcttttcatccagtgggattggtcaacctaccttgctgactatggtcagcccaactgcaagtacctccgggtaaacccagtgactgctctgaccctgcttgagaagatgaaggatactagccgcaagaacaacatgtttgcacagtttcggaaaaatgagcgagacaagcagaaactcattgacaccgtggccaagcagctccgaggactcatcagcagccaccactcatgaagggtgaccccggacccacagaggcgacctgctgcagcctctgtgtcagtctggggtccagccccagctgaccctgcatttgtgcattcttcttcaaagagagcatatgtatttttttattaacccctgtgcagtattcacataacatttccctatagtaaaagaggcacaagaataagcaagtacatgagatgttgctaggctgggactcaggggaagttattactacactatctgtgttatcttagagatggtggtatcatcaattccacagtgatgaaccacctttcatcccacggccttttatctcccaagactggctttggccatgaccttcctcatcaggcctctgagcacactctctaggaactgctgcagaaattcccctaccttagcctcccttctcccaggactcctctcttgactgcaattgcctcttcttcttcttcttcttcttcctttttgttttttttttttttgcctgcattcacaattacttttcacaaaggtgttggaaatggcatttttattttacacagatagttgcacatatatagagaaaattaggaaagtccatttttaactctaaagggaacttttttctctaaaacttacttgtaaagctactgatacagatgggccgcatggttaggggaaagctcctctgtgaaaagagcatgtttattcctcttgtacattttcctcttttaactgctattaaacaagaaagcctacatacctgtttcaaaagccacggtgttgtctcatgggtattttgttcttccatcctttttgcacagtgcagct

SEQ ID NO: 29399 - DNA, 2229 bp, Homo sapiens
gcgggtagccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctggagacagcggcagagcacgagcggatcctgcgagagatcgagagcactgacacggcctgcatcgggcccacgctcaggtctgtttatgatggtgaagaacatggacgtttcatggagaagcttgaaactcgtatccgtaatcacgaccgagaaattgagaaaatgtgcaactttcattaccagggctttgtggactctataactgaactgctgaaagtgagaggagaagcccagaaactcaaactggtaatagcaatggaagagctgaagcagtgtcgactacaacagagaaatatttctgccactgttgataaattaatgctgtgtcttccagtcctagagatgtacagcaaactgagggaccagatgaaaactaaaaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagcccagcagcaaagaaacctggataacatcgtcttgcaacaacccagaataggtagcaagaggaaatctaagaaagatgcatatataatctttgatacagagatagaaagtactagtccgaagtctgaacaggattcaggaattctggatgttgaagacgaggaagatgatgaagaggtacctggggcccaagatttggtggatttctctccagtttatcgatgtctacatatatattctgtcctgggtgcccgggaaacatttgagaattactaccgaaaacagaggcgaaaacaggctcgtttggtacttcaacctccatctaacatgcatgaaactttagatggctacaggaagtattttaatcaaattgtaggcttttttgtggttgaagatcacattttacatacaacccagggcttagtaaatagagcctacattgatgaactgtgggaaatggcactttcaaaaaccatcgcagcactccgtacccactcgtcttactgttctgatccaaaccttgtgttagatttgaagaacctcattgtgctttttgctgacacacttcaggtgtatggtttccctgtaaatcagctttttgacatgctgttagaaatcagagaccaatatagtgaaactctgctaaagaagtgggcaggtattttcagaaacatacttgattctgacaactacagtcctataccagtaacaagtgaagagatgtacaaaaaggtggtaggacaattcccatttcaagatatagaactggaaaagcaaccatttccaaaaaagtttcctttctctgaatttgtgccaaaagtttacaaccaaattaaagaatttatctacgcttgtctgaagttttcagaagatcttcatctaagctcaactgaagttgatgacatgattcggaaatcaacaaacctgttgctaaccaggactctgagcaactctctgcagaatgtaattaaaaggaagaatattgggcttactgagcttgttcagattattatcaatacaacacatttggagaaatcctgtaagtacttggaagaatttatcaccaacatcactaatgtgcttccagagacagttcacactaccaagctctatggcaccacaacttttaaggatgctagacatgcagctgaagaagagatttataccaacttaaaccagaagattgaccagttcctacagctggcagactatgactggatgaccggagatttgggcaacaaagctagtgattacctggtagacctcattgcctttcttcgtagcacctttgctgtattcacacaccttcctacatcctatagcaagactctcaagcaggaccctgaggtgttaatgaaaaaagagtgcattaaaagtgagttgaagtttaagatgttaaattttatgttacatttattttaccataataatgaaggtgatttcaaaaagagtaaggaaaagaaaacatgaaatatactggtctatatgaatgt

SEQ ID NO: 29400 - DNA, 533 bp, Homo sapiens
ggggaaactgcccccatgattcaattacctccacctggtctctcccttgatacatgggattatggagattacaattcaagatgagatttgggtggggacacaaagcctgaccatatcaaaaacttcctagaagaggtaacatgaaagcccatgctttaacataccccttgcccgaatgtggatggccttttccattatgccttacatttgttttgtaccggcagattcatattgagccattcatcctggggtgagtagttaaatgacttttacatgtgtttgttgttttctagcttgttcagattattatcaatacaacacatttggagaaatcctgtaagtacttggaagaatttatcaccaacatcactaatgtgcttccagagacagttcacactaccaagctctatggcaccacaacttttaaggtgagagggccctacagtactgtggaactgcttctggtgtacacagtctgggacgttctacctaacatggccttgtttctgtaagatggtttataacatgctctt

SEQ ID NO: 29401 - DNA, 6132 bp, Homo sapiens
  misc_feature (3359)..(3359): n is a, c, g, or t
  misc_feature (3429)..(3429): n is a, c, g, or t
gcgggtagccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctggagacagcggcagagcacgagcggatcctgcgagagatcgagagcactgacacggcctgcatcgggcccacgctcaggtctgtttatgatggtgaagaacatggacgtttcatggagaagcttgaaactcgtatccgtaatcacgaccgagaaattgagaaaatgtgcaactttcattaccagggctttgtggactctataactgaactgctgaaagtgagaggagaagcccagaaactcaaaaatcaagtgacggatactaatagaaaactacaacatgagggaaaggaactggtaatagcaatggaagagctgaagcagtgtcgactacaacagagaaatatttctgccactgttgataaattaatgctgtgtcttccagtcctagagatgtacagcaaactgagggaccagatgaaaactaaaaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagcccagcagcaaagaaacctggataacatcgtcttgcaacaacccagaataggtagcaagaggaaatctaagaaagatgcatatataatctttgatacagagatagaaagtactagtccgaagtctgaacaggattcaggaattctggatgttgaagacgaggaagatgatgaagaggtacctggggcccaagatttggtggatttctctccagtttatcgatgtctacatatatattctgtcctgggtgcccgggaaacatttgagaattactaccgaaaacagaggcgaaaacaggctcgtttggtacttcaacctccatctaacatgcatgaaactttagatggctacaggaagtattttaatcaaattgtaggcttttttgtggttgaagatcacattttacatacaacccagggcttagtaaatagagcctacattgatgaactgtgggaaatggcactttcaaaaaccatcgcagcactccgtacccactcgtcttactgttctgatccaaaccttgtgttagatttgaagaacctcattgtgctttttgctgacacacttcaggtgtatggtttccctgtaaatcagctttttgacatgctgttagaaatcagagaccaatatagtgaaactctgctaaagaagtgggcaggtattttcagaaacatacttgattctgacaactacagtcctataccagtaacaagtgaagagatgtacaaaaaggtggtaggacaattcccatttcaagatatagaactggaaaagcaaccatttccaaaaaagtttcctttctctgaatttgtgccaaaagtttacaaccaaattaaagaatttatctacgcttgtctgaagttttcagaagatcttcatctaagctcaactgaagttgatgacatgattcggaaatcaacaaacctgttgctaaccaggactctgagcaactctctgcagaatgtaattaaaaggaagaatattgggcttactgagcttgttcagattattatcaatacaacacatttggagaaatcctgtaagtacttggaagaatttatcaccaacatcactaatgtgcttccagagacagttcacactaccaagctctatggcaccacaacttttaaggatgctagacatgcagctgaagaagagatttataccaacttaaaccagaagattgaccagttcctacagctggcagactatgactggatgaccggagatttgggcaacaaagctagtgattacctggtagacctcattgcctttcttcgtagcacctttgctgtattcacacaccttcctgtaagtggcagttgctcttactttgtcctttatatataaaaagatttccttataatttagtttggtgaaagatgttagtttctgctgtaactacccaggaagattttcagtatataaaggcgcatgctatatttattaacctttaatgatatgtagaggctacttccatcattttttcattgacctttgcatttttttcatctgaaaatggttcctggtattatgtctgcttatcttcctatgatgttcaaggtaattagtacaaagacaatataaaagccttggtagaattaaaaaaagaaacttagttagaatttcagatatgtatattttagttttagaatattctttaacttttttatataaactgaaattctttgatgaaatgctccatcttttttatctaatttgtctatgttttctctgttttcttaagcatattaattatagacattcaaaatcattctttactacttcttatatatattatacatacatattggtggattttttttctcttggttttcagtgatatggtcctgtctgtttctaatatttttcggttgatgttagacattgtataaaatatgtagagattccaggtggtgttatcttccaccagaaaaggttcatgttttcctttacttagtaaatagaatgggcaggtgggttgtggtttgaagctgaccaccttagtaccatcatggactgatttggattaatattgggttgcagttgtagtgtactttgtttgcccttgttggtaggatatggctctgcagagcttttaaaaactgcctgatatgtcattgtctttttagcaccaaagaggactatagaaattcctgctcttcacagaaaccttgtctgttcagcctcctgtactctttcgttttagaatctggtaaatgtcttgagaaggagacttagcagtacccagtatcagcaattgctgatgggaaaaaaagtgttggggattgtcagtgttactttaccatccctaatgaggtttcagctcctatgtgatctgaatgtttgtgtaccccaaaaaatcatatgttgaatctaataaccagtgtgattacattaggaggtgaggccttgggaggtgatagattatgatggtagagcctcgcaaatgggattagtatacttataaaggagacttcagagagctgccttgttccttgtggccatgtgaggatacggggatacaggaagaagactccttttttatttcgcactaggaaataggccttcatcngacaccgaatctgctgataccttgatgttggacttccaagcctccagaactgtgagaattcttttgtttntaagctaccagtctatgggattttgttacattattctgaatggactaagatagctcctgtcatttttaggcattcttctactagtgagtctttttctctgaaacactgtgaaactgtgagaaatctccttgcttttcaaagattttggcttaaacccttattttcctcagccgtttagctttagaattcagtaaatatcttgagggtaaaactagtcctcaaacctctaactgtggcactctagtctgttggaagcagcaaagattccaagtttttttcgccccctagtagttagtctctgcctggttttaagattctcagtctgttgcccttgtctacgttcctcaaatgcccacaaggaaagctgcagattttcacctcacctttaaaaggttttgtcctctctgcagttttattccctttagtcttcattgcttcacagcacctgatgccttttaatatgttttttctacatgttttacttcctctcctagttgttcctagtgggagcatttatctgcagaaaattatgtcattttgtctggctttatcctgataccaaagccagacaaaaagagcacacacaaaaaaactatgagttaatctcacaattatggataaaagtaaaataaataaaattttagcaagtcaattcccagtgttttaagaaagtaattttgtactagtgtgtaggatttattccagaaatgcaaggatggtttgatattttaaaaaaatatgttaatataatttatcatattactaggtgagggagatacagtttcttgatgtattctagaaagacattttattacatccaggctacattcttgatttaaaaacaaagtttactaaattccaagcagtataatattttaataacaaaataaagaacatctatttgaaatttagtggccaccatagattgaacagtagaacaataaaacatttattttcattgacaacaggaattgggtgaagatgcttctcaccaacactttagaagttctataaaataaatgtaaaaaaagaataaattacattataatgagccatgcatgtcttagtccattcctgctcccataacaggatactgtagactgagaaatttatggacaacagaaatttgtttctcacagttctggaggctgcaaagtccaatattaagatgtcagcagattcagtgtctgataaagtcctgttactcataaatggcacctctgtatccttacgtggcagagaaggcaaaaaggacaaactcactcccccaatcccttctataaggcactaatccaattaatgagtgatgtaatcacttctgaaatttttgtgccctcccccacaaaaattaaaaattaaaaaaaataacaaagttgcattggggattaaatttcaatatgaattttggcaaggctcaaacatttcaaaccatagcacatgcatattattattcataggttattattatctaaatagaacatactaaaaattcattaagaccaataagagtttaggttagatgattcacttagaaaacaaataaacttttcttatattagcaatgcccacatagaaaatatagtgtcaaaagtgtcttatttactattgggacatagatataatttttctatgcagctacttagcaagtcaatttagaaataatgtgacaacatcacagagtaatataaaagagactttcttatgcacaaatatatatggtattccaggatgggagtatttcattctgtagaaagttttttcaaatttaatctaattgcagtgagtatcaagtaaatttgtttagggaagaatcttaatgaaatcattctgaaattcatttgtaagcaaaaatggacaatatttggtaaaaaatgataacatgaacataatttgtaactctattaataagacatacaaattaagcttgtgtgatatttttgactataaactactcagaaataagaaaatggtaacactccttgtttataagaaatatttgtggaaataggtattttcatacctgctgctaggggtctagttattgtagtctttttggagtcagtttttcaatatgcctcagaaaccccttaaaatgtgcttacctttttactatgtaattccccttttagaatttgaacttaatgaaataatcatgattgtattataatattcagatgtaactatatttaatacaatgtattttgtatagcgaggagtaggtataaattaaaaatccaacaaacaaatgtgttcacaaactaaattattgtatattcatataatgtgatattcattaaattaatgtaaatttatatttattcattaaaaatatattcgttatttcttaactggaaaacaacacaacaacacaacaacaaaaacaacaaaaacacaaaaaaaaacacaaaaaaacacaaaaaaaacaaacaacacaacaaaaccccaaacacacaaacaaacaaaaaaaaacataacagcatgtgcgggcgcgcggcagacggtgcggagcgaagcaagaaaagtagaagcgtcagacgacagaaaagaaagtgagggggagcggggcgggcgacaaggctgagtagagtatggacgaagaccttgggcggtgatggccgcgccacgagcgcagaacgtcatgagatctctgccggccaccaaagaccgagggggttggggcaacacaccacacacaaaaaacaa

SEQ ID NO: 29402 - DNA, 4253 bp, Homo sapiens
tgcgaccttattcagggaaagaagtatcatctcttgcgaaaggtaatacccggacagactattggagcttacatagagcttgttcagattattatcaatacaacacatttggagaaatcctgtaagtacttggaagaatttatcaccaacatcactaatgtgcttccagagacagttcacactaccaagctctatggcaccacaacttttaaggatgctagacatgcagctgaagaagagatttataccaacttaaaccagaagattgaccagttcctacagctggcagactatgactggatgaccggagatttgggcaacaaagctagtgattacctggtagacctcattgcctttcttcgtagcacctttgctgtattcacacaccttcctggaaaggtggcccagacagcgtgtatgtcagcttgcaagcatttagccacatccttgatgcaacttttgttggaagctgaagtgcggcagctcaccttgggagcattacagcagttcaacttggacgtcagagaatgtgaacagtttgccagatccggcccggtgcctgggttccaggaggacacgctgcagttggccttcatcgacttgagacaacttttggatcttttcatccagtgggattggtcaacctaccttgctgactatggtcagcccaactgcaagtacctccgggtaaacccagtgactgctctgaccctgcttgagaagatgaaggatactagccgcaagaacaacatgtttgcacagtttcggaaaaatgagcgagacaagcagaaactcattgacaccgtggccaagcagctccgaggactcatcagcagccaccactcatgaagggtgaccccggacccacagaggcgacctgctgcagcctctgtgtcagtctggggtccagccccagctgaccctgcatttgtgcattcttcttcaaagagagcatatgtatttttttattaacccctgtgcagtattcacataacatttccctatagtaaaagaggcacaagaataagcaagtacatgagatgttgctaggctgggactcaggggaagttattactacactatctgtgttatcttagagatggtggtatcatcaattccacagtgatgaaccacctttcatccatggctctaaagcttaggtctggggcttaggaaccataaaaagtgggtatctggcgctgggaggtagagtgagtaagcaaaaggatactaaaatatgtcctgttcactcttggatgcccattcaccacatagatgaggctgattcttctcaatacaaggaaagggcatggcaaacattactatttagtacactaagggcagctctggagggtcatctcctcagtctgctgactttcactggcttgtgaacaagcatggcatatggcaagatgacagcttcattccaatcccccaagaatggcggtttctttagcctgatctaaccccaggcttttattgcaattttttctagggcaggatacagctaagtagacagcagtaataattggatcccatgtttaactgcatattgccccagctctaggagtgttgagtctcaactcgaagagtttttctggatcttgaaagccagttttcatggaatcagagacccaatcccttccctgttcatctcatttccttcacttacagtcagagcacttggttcaggacataaatcaacagttacttccataggccttcacagggcgtttcagacttagcctcctccagtaatgccattgaaatagttcagatttcggaagcctaaaaatggcctttaccttacccttaggtgtaacctgaggattagttgggattgttcctttatgttttaaaaccagctttttggttatcatctttaaggaaatgtcaccagctctgcactgtgggggcagccatgcctggactggatgcctctagggatggagacattgttaccataaagtcgacagagccaaccatggcttgtggcttgttgcctctggcccaactgtccttcactaaataatatcctagatattattttgttgctcaagcccaaggttcccaccctcttttgagatccccaaagccatctttggccttgtctaagaaagattgcctataatcctgtcctccaaactctaaagcctggagcagcttagcgtggaggctgcactcattgacccagatggactcctgagacttaacgcaagggctttgctatgaggtcagtcgggggaaactgtactttaagacacttcagaaagatgctactggctagtagcagaaagatggctagtggcaagagtataattgtgcatcaccaaacaatgacaaataagccacacaggcatttccagcttggattgatgggaggagagactcatcaaacagaattcttcactacctttgtcagctactgagttgcttctggggagggaagtacttccttgcccctccccaacccccctacctcaccatatcctatcatatcttgatagtcatggggaagaggatgtgcacacagacatacaaatttcctcaaagctggagagaccaggctacatgtgagctcatagatgctgctgaggctcatcctgagggctggatggttggccagggtttcagaatgagggtaagggatgagcactgccacccagaacttgataagccaagagaaggcaggagccaaaatggcatcgccaagctctcatctttgttgaaacaagtgagaaacgattatattaatctgaagttctattgcttgagaagagttcaaaacacttctctttgctagtacccagtttgcagcaagatctcttcagctttaagtgctgagagactttgaagtggaaatggagagatgtgtaagcatggcacagtgtttgtctttttagaggatcatcattgctggtctggtctcaaacctctgccttggaagaactgtgctatacaggaaaaagtgaacaaggtggaggaataggggttattctgcacagaagtcccatgaaaggaaaagcttattcaagctcaagacataaagatggaccctttgatatatcttctctccattcttagtctgccttcaccttatctaacaaaaaacaacatgcagctactgagttgtatgtagagacatactcttggtgggccagggaaggtaaaaacagggaccagcaatgtcaagtttttgaactagaaaagtgggatgtttttagttttgtctataacctgtagctgggccaacccttgagaggacttgtgcaaagcatgtgtgcccagacccatcagactcctcagatatggcctcaaatacctagagatgtagaagtaccgtggagggcctcaataagagggcaagcacacagatggctagaagcctgtatggcttctggtcaggatgaacccttggccaagttcttgaggaaaccaggtctatattcctgaagggacagttcagtttgggactctattaggtttcagtagtaatataggctgcttgcatcattttaacattcatagggaaaatctctttgagcaggctataaatgaagctgttgcaggtagggaagaacaggacctgaaaatgggaaccaggaagtgagatcctgttggcaaagggaatgtagagcttccagggtgcattgcccactgttctcattgcataccagtcctccaagtcagtctagccttactgtacacttgacaagtgcttactcagcaagtcccagacccacggccttttatctcccaagactggctttggccatgaccttcctcatcaggcctctgagcacactctctaggaactgctgcagaaattcccctaccttagcctcccttctcccaggactcctctcttgactgcaattgcctcttcttcttcttcttcttcttcctttttgttttttttttttttgcctgcattcacaattacttttcacaaaggtgttggaaatggcatttttattttacacagatagttgcacatatatagagaaaattaggaaagtccatttttaactctaaagggaacttttttctctaaaacttacttgtaaagctactgatacagatgggccgcatggttaggggaaagctcctctgtgaaaagagcatgtttattcctcttgtacattttcctcttttaactgctattaaacaagaaagcctacatacctgtttcaaaagccacggtgttgtctcatgggtattttgttcttccatcctttttgcacagtgcagct

SEQ ID NO: 29403 - DNA, 2531 bp, Homo sapiens
gcgggtagccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctggagacagcggcagagcacgagcggatcctgcgagagatcgagagcactgacacggcctgcatcgggcccacgctcaggtctgtttatgatggtgaagaacatggacgtttcatggagaagcttgaaactcgtatccgtaatcacgaccgagaaattgagaaaatgtgcaactttcattaccagggctttgtggactctataactgaactgctgaaagtgagaggagaagcccagaaactcaaactggtaatagcaatggaagagctgaagcagtgtcgactacaacagagaaatatttctgccactgttgataaattaatgctgtgtcttccagtcctagagatgtacagcaaactgagggaccagatgaaaactaaaaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagcccagcagcaaagaaacctggataacatcgtcttgcaacaacccagaataggtagcaagaggaaatctaagaaagatgcatatataatctttgatacagagatagaaagtactagtccgaagtctgaacaggattcaggaattctggatgttgaagacgaggaagatgatgaagaggtacctggggcccaagatttggtggatttctctccagtttatcgatgtctacatatatattctgtcctgggtgcccgggaaacatttgagaattactaccgaaaacagaggcgaaaacaggctcgtttggtacttcaacctccatctaacatgcatgaaactttagatggctacaggaagtattttaatcaaattgtaggcttttttgtggttgaagatcacattttacatacaacccagggcttagtaaatagagcctacattgatgaactgtgggaaatggcactttcaaaaaccatcgcagcactccgtacccactcgtcttactgttctgatccaaaccttgtgttagatttgaagaacctcattgtgctttttgctgacacacttcaggtgtatggtttccctgtaaatcagctttttgacatgctgttagaaatcagagaccaatatagtgaaactctgctaaagaagtgggcaggtattttcagaaacatacttgattctgacaactacagtcctataccagtaacaagtgaagagatgtacaaaaaggtggtaggacaattcccatttcaagatatagaactggaaaagcaaccatttccaaaaaagtttcctttctctgaatttgtgccaaaagtttacaaccaaattaaagaatttatctacgcttgtctgaagttttcagaagatcttcatctaagctcaactgaagttgatgacatgattcggaaatcaacaaacctgttgctaaccaggactctgagcaactctctgcagaatgtaattaaaaggaagaatattgggcttactgagcttgttcagattattatcaatacaacacatttggagaaatcctgtaagtacttggaagaatttatcaccaacatcactaatgtgcttccagagacagttcacactaccaagctctatggcaccacaacttttaaggatgctagacatgcagctgaagaagagatttataccaacttaaaccagaagattgaccagttcctacagctggcagactatgactggatgaccggagatttgggcaacaaagctagtgattacctggtagacctcattgcctttcttcgtagcacctttgctgtattcacacaccttcctggaaaggtggcccagacagcgtgtatgtcagcttgcaagcatttagccacatccttgatgcaacttttgttggaagctgaagtgcggcagctcaccttgggagcattacagcagttcaacttggacgtcagagaatgtgaacagtttgccagatccggcccggtgcctgggttccaggaggacacgctgcagttggccttcatcgacttgagacaagtaagtctttgtgtttttgttttttgtttttcttttaagatgtgtgactgaagaccatcaggtcttaaggaaaaggggaagggagggggattggcgttggcgattcacattggagacctaagggttttccctgtatttgaggccacctcttttatttagctatctgggatccttagctatggtggagttaaaggttttgtgggtagaagggaaccgcgggggtgggaggacgccccgcgagtccgagcacccgtcagtcgtttcctcc

SEQ ID NO: 29404 - DNA, 466 bp, Homo sapiens
attgaaaagctaaaggaagaaaactagagaaagtgaaggatattttcctaacttggtatttgcaaactctgatgcctgtttatcaaattggagttctccttgggagtgagttgaaggaggtcccttggggcccccatcccctggaaaggagctggtgtggaaagtcacctggtgtggtgactcacgcctgcaatctcaccactttgggaggctgaagtggtaggattgcttaggccaggagttcgagaccagcctgggcaacgtagtgagaccctgtctctactaaaaattaaaaaattagctgggcatggtgatgtgtgcctgtagtcccagccacttgggaggctgaggcaggaggatctcttgaagctcaggagcttgaggctgcagtgagctaggattgccccactgcccttcagcctggatgacagagtgagaccttgtctctaacaaaagaaaaagaaaa

SEQ ID NO: 29405 - DNA, 379 bp, Homo sapiens
gttacttccattattccttccagcagcccacaagtagatattacaattagtttacagatgactggtaggatgatcaaagtaaatgaattagaggtggagctggggatcagacccaatctgtcaggttccaaagtgcaagctatatgatggcaccccatcaattatttcatggacaagaccaaggagcactcaaaatctgtaagggtttcggtagttaacattattgtgtgattaccatgggcgtcagtagaaacacacaaagagccaggttgctccaggttgctttggaactccagacacatcccagcacctctgggcctcagtttcctcaattccacaataaggctgccagtgcccacttactgaggctttatggtgt

SEQ ID NO: 29406 - DNA, 364 bp, Homo sapiens
tacttctgccaatagatttccatggaagtggagctacgtaacttctgaggctaagtcataatgggccatgctgctgccactgtaacagacactcttggaaccctgagtgccatttaagaagactgaccatcctgagtccatcatgctggggtcaccaaggtgctctgattgacactcctagctgggattgcctttcatctttcacagacttcccagcccaggcaccagacacaggagtgaaagagtcgttggacgagggcccttcagcccaggctgttcccagatcccaaccactggagtcctcaccagcagttcagatcatctgacctgtggccccaaacatggagcagttatgcccttttca

SEQ ID NO: 29407 - DNA, 396 bp, Homo sapiens
acaataaaagtcatatatcagaagcccacagctgacatcaaacattgaaaagctaaaagcttgcccaacaagattaggaacaagacaagaatgcccactctcactaattctattcaccatagcactgaaagttctagccagagcaactaggaaagaaaaagaaaccaaaaccatccgaaacataaaagaagaaggcaattgtctctgtttgcagatgacgtcatcttacatatagaaaactctaaagactccaccaacaaaactggtagaactaataaattaattcagtaaaattgcaggatataacattaacatataaaaattagttgtgtttccatatactaacaatgaactattcaaaaaagacattaagaaagcaatgccatgtataatagc

SEQ ID NO: 29408 - DNA, 175 bp, Homo sapiens
tgccaccaccttctagcctgggcaacagagtgagatcctgtctcaaaaaaaaaaaaaaaagacaagacaagaaaaaagtaattctgctttctcttactccaggtcaaggtttagctgctggcctcctgtaagaaggtaagaagaaactagtgtagtttcttctacctccgtatat

SEQ ID NO: 29409 - DNA, 542 bp, Homo sapiens
gatacgtaggacggcacacagcctctcggcaagcaggctcattcctgcacgaagcttgcaaggcagctctctctaaactggcaaagaacctttcttggtcatggttttcctccttgcaatctggcctcactttagggagatattctcatcagggaggctgagaccaactccctctcctgggggtggcgcctccctgacaccagctgtggtgtgcagatgtgcagtaaatgtcgcatcgttatcacttcaaagataatttcattcctggaagactggaaatccttaccctgggttttggcaaacacttacattagagttgctcagtcagttgcagctttaaaccatggcgccccctgcccacccagccagctgataatttatgagaaacaggtgtacaaagaatgagtacattgggctgcggacccagatcaaacttcagaaaatgcagattaccaagggttaatcatttttgagcaatcttatttccactgagactgcatctgcacagcaaagcaagccactgaggcaaaaagaaaaaaaaa

SEQ ID NO: 29410 - DNA, 428 bp, Homo sapiens
aaagaaaatgacttctgcagagactgaatcatctttatgtcctctatggtagttggcacttagtagatattaaataaaaaacaggctgggcaagatggctcatgcctgtaatcccagtacttcgggaggctgaagcaggtggatcacttgagctcaggagttcaagaccagcctgggcaacatggtaaaatcctatctctacaaaaactataaaaagtagcgggatgtggtggcatgtgcccatagacccagctacttggaaggctgaagtgggaggattgcttgagcccggggggtggaagttggactgagccaaggtccagctccagcctgggccacagagggagaccctgtctcaaaacaaacaaacaaacaaatctctttaactcccaaaatggaaagttctccaagatatatgttaagtgatt

SEQ ID NO: 29411 - DNA, 540 bp, Homo sapiens
ttatctttagttgggtgaagttaccatttaaacttgctgcctccctctcacatatattttctagtggttaaaaaaggatgttttgtagactggagagaaagggacttccaaggaggcaagtggaagggttaggatggcgggtagtggaattagacaacatctctggggtccaagaggcaccttgagagttccatgctgggatccccgaatctaagctgcaaaagggcatatggtgtctcaagctgcttgaaagaagtattgtctcagattttacttagtaagcattggtcaggaaggccaggtcaacattaagaagcagaaattagtgtagactgagaatgagccctgtcatgtgcctgacagaaaataggctgggccaatctggaactctacttaaaaaagaagcagctgtggctgggcgtggtggctcacacctgtaatcccagcactttgggaggccgaggcgagtggattgccagagctcaggagtttgaaactagcctaggcaacacggtgaaaccccctctctactaaaataca

SEQ ID NO: 29412 - DNA, 547 bp, Homo sapiens
gacagcgtgagactccatcttaaaaaaaaaggtaaataatgtgtatggtttaaagagttttgataaatggatgcccctgtgtaaccatcacaacactctagatacagaacattttcatcagccctaaaggttctcttgtgccccttctcagttaaccagggagtccccccactcctccagccctttcagcccaggcaatacttttctgggctgaaaagatttttttacattaagaaatataaggagttccggccgggcttggtggcttatgcctgtaatcccagcactttaggaggccgaggcgagcggatcacgaggtcaggagatccagaccatcctggctaacacggtgaaaccccgtctctactaaaaatacaaaaaattagccgagcgtggtggcgggcacctgtaatcccagctactcgggaggctgaggcaggagaatggcgtgaacccaggaggtggagcttgcaataagccgagatcgcgccactgcactccagcctgggcgacagagcgagactccatctcaaagaaaaaaaaaaaa

SEQ ID NO: 29413 - DNA, 304 bp, Homo sapiens
gctgtggggctggcaggaagctgtcctggacagggcacagagtggccaggacaatagggaggagaggcaccggctggggggatttgccagaggcggtgcctcccttccccagcagggcatgtgctccagatcttgtgccacttgacatgcagagcctgggtgcaacctgcagaaaccatgtgggctgtgccccagccttggggtgggtgtggacctggtctccctggggatactggaagggcctctgggagatatttagggcgcagcctggacatctataccatgcactggcaaacatacaaac

SEQ ID NO: 29414 - DNA, 726 bp, Homo sapiens
ggcatttggaaaaagtgaatttcctggacttaactcatgtaaatagctctactgcagagctgtgtgtttagtgacagtgcagtcaggggcattcccacagctgtcacagcacggcccagcatcattgtagccagatcctaacatgccaacatcacctcttgccatttagcccctagtgagaaattgggagctaccaggcaggtgcccagtgcattcagggaagatgggcacaacatcaggatgggtgtgtctggaagctcctcttcactgaccagggctgggcagggccaccctgggctggtgaggctgccctgcagggcttctcactatgtagcaccagtcaccagcccaggtcacagaagaagcccctcccagcacccactggagaggggaagctgaagcccagggagacgggctccatggtggtcccacatggagctgttttgcaaaccctggaaaaggcggctctccctgtcccaacactcttcagagacaggaagacagagttaatcttgaatgaatgttatttctacttagtcctaagcaagaataagctgccctcttggtgatcatactttatacggagtgctatcgtttatgaaatgctttcagtatgctttttaaattatgcaggcaaaataaccacacttcagaaaatgtggacttctgaaaaataaaatccccataattcttaataaaactgccttttgcactttgatacattac

SEQ ID NO: 29415 - DNA, 369 bp, Homo sapiens
tggtagcatccttgcttggtgtttcccctggtcctgggataggggcagggagagaagagaagaaggtggtcccacatggagctgttttgcaaaccctggaaaaggcggctctccctgtcccaacactcttcagagacaggaagacagagttaatcttgaatgaatgttatttctacttagtcctaagcaagaataagctgccctcttggtgatcatactttatacggagtgctatcgtttatgaaatgctttcagtatgctttttaaattatgcaggcaaaataaccacacttcagaaaatgtggacttctgaaaaataaaatccccataattcttaataaaactgccttttgcactttgatacattac

SEQ ID NO: 29416 - DNA, 496 bp, Homo sapiens
ctcaacatcattgatcattagagaaatgcagccataaaaaggaacaagattatgtcctttgcagggatgtggatggagctggaagccgttatccttagcaaactaatgcaggaaaagaaaaccaaacactgcatgctgtcatttataagtggagctgaatgatgagaacacatggccacttcgtggggaacaacacactctggggcctgtcgggggtgtgggggtagagagagtatcaggaagaatcgctaatggatcctgggcttaatacctaggtgatgggttgatctctgcggcagaccaccatggcacacgtttacctctgtaaaaaacctgcccatgtaccctggaaattaaaagttggagaaaaaaaggaaaggaagagaataggaaaggagaacgaatcagaggaagaaagagaaaagtgggcaaagaaagaaaaggcaaaaagaatagagataggaaaagaagacagaaaataatagaagaaaaagaa

SEQ ID NO: 29417 - DNA, 1368 bp, Homo sapiens
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagataaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 29418 - DNA, 800 bp, Homo sapiens
cttgaacccacagccaggggagcgtgggtgaaatatgagcagacgttttcaccagctgttaaaacctagcaggggcattaggaatcaatcgcagactgtgcctcctgtgacttggcaaacctccatgaggaaggctcaagggattggaagagcagtcacaggtctccaccagccaagagcaaacctgagcagagctaagcacttttgtgccctctgaagcaaggcaaccccataaccttgcagagattcaggaatgatggaagctgaggagctacatggccatgtcaggaggatgacgagatcgccaggcagctgccatcaagttagggttcagagtggtcctgcaggagaaggggagatgcccctgcccgggaccacacaggacagaagggcatctggacagtgccaggccatgttcagaaagtgaagtgcctttcccataggaaggttctgggcccaaacacttactgagcacctactgtgtagctggcatattcaataagtgttaaaggaagggagagagagagagagactgggagggaagaaaggaggaggatgcgcccctggacagtacgtgctgtcactctgagtctcctccaaggccagtttgcggcttctaccttacatctttatacctttgaattggatgaaatgtattttctcttggtcattagggcactgatgcaaaatttcagtatgaccttgttggttctttccacctggtccttaaggttctgaggaccgtgtatgaagcagtatcatgcaggagaagaaggcaggcaaacctggttttgaattcc

SEQ ID NO: 29419 - DNA, 266 bp, Homo sapiens
ttcttcaaggcccagggccatcccctgcagaggtagggtgggctgcaagacctcaggcccctgcctcatgggactctctgatgggcttcaaccgtgggctcttgcaggcatggagcctgtatcatgacaccttacacccaaggccagcaatgcaaggagagtatggacatcaaattctttccttccagaggctgaattcttcaaagacacacgcggtcgtcccttgctcttggcattaacggtggagaacccagctgaggtggctt

SEQ ID NO: 29420 - DNA, 451 bp, Homo sapiens
cgccatcatgggattcaaccaagctgggccatcgttgcttcgccctctgttcccctcatggcagcagtgctgggctccctgcttcccgtggggtcccgcagcactcggcacctgtgaggattggaggatgggctgtactcttttaaagactggggatagggccaggttctgtggctcatgcctgtaatcccagcactttgggataccgaggcgggtggatcacttgaggtcgggagattgagaccggcctggccaacatgcagaaaccccgtttctactgcaaacacaaaaaattagccgggcatggtggcgcatgcctgtaatcccagctatttcggaggctgaggcaggagaatcgcttgaacctgggaggtggaggctgcagtgagcggagattgtgccattgcactgaagcctgggtgacagagtgagaccctatctccaaaaaaaa

SEQ ID NO: 29421 - DNA, 374 bp, Homo sapiens
gaaagagatgtggtacagtcagtgttttgagaaaaatgaattttgaagtagctgtgtaataaatgaatgatgtacataaaagaattgccaagttgaaatgttatgtacttatagtagtaccattctgtgtaatttttctttagcagcacttagcaccccaggtgtaaacatagaagatggaaactagactgatccagaattacattctactttctactatatgtacatataaatatgttcaactctctcattaaattgtaagactggcattacctttatattccttacatcttctacattttgaaatactatggaaaaagccagcagtcagacagacaagacttgtattcatatcccagctctgctacttaata

SEQ ID NO: 29422 - DNA, 570 bp, Homo sapiens
tctgaaactgggtttatctaatacattgataaattattgcaaaggtacttttatcgttgaaatcacttcacttttaccctgataaatatcagtgactaggaatgaccttcggatagcgtttacatctgtaaccaatctgacaataatgtgttcatgaggtgcctatggattaaatcacacactggcatatttaagctgaaggtcagtctggaaaataaatttactatattgactgaaataccactctttgtgtaggtatttgtgatatatttaagaaaacgctaaaaagaatggaaattgtatgacaataacttaagtctttctccaaagtgcatgcagtcttttgcgatacctcattcagccgagtatttgtgctcttcctcattcagtataaggaagctttcagtttgcttagaaggcaacattggaatgttagagttcatcagaaacatagaattttaaactgtgagttccactgaatacattttaatgtctggtaggaagaatcaaacacctatttaaagatggcaatatataataatcattttaaaagtatttgattaaacctga

SEQ ID NO: 29423 - DNA, 609 bp, Homo sapiens
ggggcaacaaacgaaggggtcagtgctcgtttttcggtggacagtcagtagataacaagcatataaaatttggtgaatcaagatatgaaagcaaaatggcattaaagttaaactggtaactgtgctagaagtctattaatgatgtaacatgtattttgccattttgatgcaggagggtaacaagacttatggttcgtcttgtgcctttgtagcctttgaatttcttaaaaaccctaagtggatgcatcacatttataatgttaaaaagattgcaaggctgggattataggcgtgagccacagcacccggccgattttaccttaagtatattcttattgcttattacttcatactcaaactgacttataaggtagagaaaatcataatgtgtacccagatagtgctatttcagtttagaaaataaattcattttttatttcttgagattatttgaaagtacattgtagaaatggcacatttatggaactactttatggctgtgcctctcttgcagggaattttgcctccccctttccttttcccaaaaatactattagcttgcctaatttaacctttcactttttttatccccatcttcccccacaaaag

SEQ ID NO: 29424 - DNA, 700 bp, Homo sapiens
cttgctgatcatagtgaattatgctgataagaatgggaaacaagattattgggaataaattgaaaaatattaaataggtttttatgcgtcaagggtaaaaaaaatgtgttttgagtaaatgatctgaaatacagcatgcttttttggtaaaagcttagtataatgtagggtgaagttaaggcgttggcgataaccagaatcataattctcattttaaataatgctatgctacatctgcacaaaatagattatgtatatttttggctgctgtaccatgaaaatgatgactaaaacgaggtctagagagggatagtttaaaaatgatggtagggctagagatggaatccatgattgaggaggactgtagattttacttaactatattctttctttttaatttatttttattttattttattttttttgagacgaagtctcgctctgtctcccaggctggagtgcagtggcgccatgccgtctcactgcaacctccgcattccagattcaagtgattcttctgcctcagcctcccaggtagctggggctacaggcgccggcgccaccacgcccggctaatttttgtatttttagtagagacgaagtttcaccatgttagtcaggctggtctcgaactcctgaccttggatccgcccccctcggccttccaaagtgcctgggattataggcgtgagccacagca

SEQ ID NO: 29425 - DNA, 549 bp, Homo sapiens
atttgtgttagcgtcgacattagctatggataagcttgacttttccccctagcctataaaatcctgaagaggaaagattattcttctgctctgtatgtgtctcacatagtagctgctcagtaaaggcttgtgaaattcatttgaactgatcagcttctaaccgtgaaactcttctaaatgacaggcatgatatacaaatcatgctgtgtaattgtcacaagaaccctgtgagatatttattatcttcgtgttatatataaagaaactgaagtggtggcttatgcctgtaatcccagcactttgggaggctgaggcgggtggatcacctgtggtcaggagttccagaccagcctggccaacgtggtgaaaacccgtctctactaaaaatacaaaaattagctgggcttggtggtgggtgcctgtaatcccagctactcaggaggctgaagtgggagaatcacttgaacccgtgtggcggaggttacagtgagccgagattgtgccactgcactctagcctgggcgacaaagcgagactccgcctcaaaca

SEQ ID NO: 29426 - DNA, 478 bp, Homo sapiens
gctgttatggagctacagtatgcatccatgaacttttcacaaatttctacttaaaaaaatcaataccactatgtactatcaagttcttaaaaatttaagaacttaaaaattaatgtttaagaaaatttaaaatttaagtttaagaacttaaataacaggacagctttcatacacatcatagagtaaagaagatacactttcttaggagaaataaaaaagattaagtattcatgattggttactgctgtggtttgaatgtctccaccaaaacacatgttaaatttaattgccaatgtaacagtattggggaggtgggggcttttaacagggtgattagcttatgaggggctccaccttcatggaaaaggttaatggccccgatgggaaggcgtggggtcagttatttacaggggtggggctcctaataaaagtgcaaggtggacttatctctctatcttgtggaagggtgccttccacc

SEQ ID NO: 29427 - DNA, 975 bp, Homo sapiens
taaggtggcttgggagggaccagttttcctagatgcaggagacagcgtccatagtttcagttcgaagcaactggtggcaaaaggttagcatttaagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccggaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtgacccctgaggagttcatgaactactatgcaggtgtgagcgcatccattgacactgatgtgtacttcatcatcatgatgagaaccgcctggaagctttaagcacatgacctggggaccaggccctgggacagccatgtggctccaaatgactaaatgtcagctcaaaaaccagaatcgtatttgatttcacactcatcctaatgtttttttctgtgtcaaaatattgcattttctggggccaaaaaacaggcagaaataaaagacattgagtagccaactgtgagtttgccttgcctaagactgtttcctttgttctaaaataggacttaaataaaatgagctctgtaaagc

SEQ ID NO: 29428 - DNA, 1011 bp, Homo sapiens
aacttgagaaaaggcagaaccagagtagagattgacagtgagctgagccaatcaggctgtgaatctgcagcagtgatcccaggtcctccaattaatactaagagagtggaccagggcccctgaggaagacagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccggaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtgacccctgaggagttcatgaactactatgcaggtgtgagcgcatccattgacactgatgtgtacttcatcatcatgatgagaaccgcctggaagctttaagcacatgacctggggaccaggccctgggacagccatgtggctccaaatgactaaatgtcagctcaaaaaccagaatcgtatttgatttcacactcatcctaatgtttttttctgtgtcaaaatattgcattttctggggccaaaaaacaggcagaaataaaagacattgagtagccaactgtgagtttgccttgcctaagactgtttcctttgttctaaaataggacttaaataaaatgagctctgtaaagc

SEQ ID NO: 29429 - DNA, 976 bp, Homo sapiens
aacttgagaaaaggcagaaccagagtagagattgacagtgagctgagccaatcaggctgtgaatctgcagcagtgatcccaggtcctccaattaatactaagagagtggaccagggcccctgaggaagacagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccggaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtgacccctgaggagttcatgaactactatgcaggtgtgagcgcatccattgacactgatgtgtacttcatcatcatgatgagaaccgcctggaagctttaagcacatgacctggggaccaggccctgggacagccatgtggctccaaatgactaaatgtcagctcaaaaaccagaatcgtatttgatttcacactcatcctaatgtttttttctgtgtcaaaatattgcattttctggggccaaaaaacaggcagaaataaagagcgatgcggccgtttgataaattgaaataaatagttagtaaaaacacgactaac

SEQ ID NO: 29430 - DNA, 676 bp, Homo sapiens
taaggtggcttgggagggaccagttttcctagatgcaggagacagcgtccatagtttcagttcgaagcaactggtggcaaaaggttagcatttaagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccggaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtaagtaaaagagcctaatctaggggaaatttcttcaattcgaaattgtaaatgg

SEQ ID NO: 29431 - DNA, 973 bp, Homo sapiens
aacttgagaaaaggcagaaccagagtagagattgacagtgagctgagccaatcaggctgtgaatctgcagcagtgatcccaggtcctccaattaatactaagagagtggaccagggcccctgaggaagacagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccggaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtgacccctgaggagttcatgaactactatgcaggtgtgagcgcatccattgacactgatgtgtacttcatcatcatgatgagaaccgcctggaagctttaagcacatgacctggggaccaggccctgggacagccatgtggctccaaatgactaaatgtcagctcaaaaaccagaatcgtatttgatttcacactcatcctaatgtttttttctgtgtcaaaatattgcattttctggggccaaaaaacaggcagaaataaatgagatgcgtccgaatttttatatataatatcaacggcgtcgatccgaaggcg

SEQ ID NO: 29432 - DNA, 548 bp, Homo sapiens
ctccctcatgttagattgttttaaagcagatcctagatgttatatccttttatccataaatattttattatgtatctctaaatgatactcttttaaaaaaacatagtatcattatcaaacctaaaaagttaacagtgattccttaatgtcatcaaatatgggatcaatattcaaatttctgcagttgtctcataattattttgtagctaatttaaatccagatctaaacaaggtctatacagtgcatttggttgatatgtctcttaagacttttaatttgtagcttttctgtcacccccttgaatttatttcttgaagaaaccaggttgttgatcctgtagaatttcttatgatagctaccatttactgagtgcttactctgctaggtattatgccaagggttgctggtaaatccacttaattctcataccaatccttagatgtattataatagacctttttctgatgttatatataagtaaattgaggtttgggaatatctaggtaacttagccgtagtcacatatctggattcagataggaggggg

SEQ ID NO: 29433 - DNA, 345 bp, Homo sapiens
tgtgcaaaaacataatgcatagaggggtagcattcatcagaataaggtcagaaaaatggaggactccagtgttttttgcgattgctttccgtgtttatgtgtgtgtgtgtgtatgggcgcacgcgcatgcatgcatgtgcacacttgtatctgtgtttctgacatatgggcaacaggtctactgcaggctggactccctctctgtaggctctagggacttctccataagaggatgacctacttgacctatttttgcaagtatcttttgccattttcctaccctctgcttccctactcccatcagacatgttaatggctcatatcatcttctcctttcatcagcca

SEQ ID NO: 29434 - DNA, 334 bp, Homo sapiens
cacatgcctggagttcaggagtgtaagaataggcaacctgaacaactagacacctcaaagagccaaggagttcagaatgccaaccattccataaaactagtccatggtggaaaaaaatcacaatagtgcttgcctctggagggaaaggattaactggatgatgtacaagaggattctctggggtattgaaaatgtgctctcaatatcttgttagggacgtggtacatgtggctgtatgcatttgtcaaaactcaccaaatggtccacttgagacctgtgtatatcattgtatgtaagtttaacctaaaaaaagacaaataaaaaagaacacttc

SEQ ID NO: 29435 - DNA, 365 bp, Homo sapiens
ggcaccctttgacggggctgcttcactattcagaacaacctcagagcatcccaatgtctgctgaataaaaaagtcatactggcggccaggcgcggtggctcatgcctgtaatcccagcactttgggaggccaaggcaggcagatcacaaggtcaggagatcgagaccatcctggctaacacggtgaaaccccgtctctactaaaaatacaaaaaattagtcaggtatggtggtgggcgcctgtagtcccagctactcaggaggctgaggcaggagaatggcgtgaacccgggaggcggagcttgcagtgagccgagactgagccactgcattccagcctgggcgacagagcgagactccgtctca

SEQ ID NO: 29436 - DNA, 383 bp, Homo sapiens
agagaacaaaaaccgtaggaaatttgtagaaagaggggtcaccaacagtgccaaatattaattgtggcgatatcaaataggatgaagcctgaaaaataggccaaagtctgactcctaggaggtgattaatagtccctcagagaattggtccattaaaatactgagggcataggcctagattgcagcaatttaacaagggcttgtggaagtggaggcagtaagagtagattcaacctttaacaaatgtgtcagaaaaaaatggaggaaaataaaaacatttggtttgtgtagggaaaagagtgatagtagcttcaggaaataagattggaaggaagatgttattttttttcaactgttcttgtttgcttttaggataaggcaat

SEQ ID NO: 29437 - DNA, 233 bp, Homo sapiens
cctagcaattcccagacccttttcttgcagggtgttagatttagggatccaactgggaaaaaaatatctgcaacaaatacggcaaatgactcataattttaattcagtaagggctagaaagccaacaccttaacaacaggtgaaaggcggaacactgtcacctttcacaacaggtgaatggccaaaaatgctgaaaaaatgttctgtctcactgatagtgaaaaagaaatgca

SEQ ID NO: 29438 - DNA, 447 bp, Homo sapiens
ctggacacacacacctggacgcacacacctggacacacatacctagacacaccagaatcaaaatgttcaagacaaagacaaggagaaaccttgaaaggaacagaataaaatggctcaccacaaagaagggaacccagtaggattaacacttgatctgtctgtaaaaggatggaggccagaaggcagtgggataacatattcaaagtgctcagaggaagaaactattaatccacaatcctatatccagcaaggccatctgtcagacatgaaggtgaaataaatttcaagataagcaaaaacggagagaatttcttgctagctgaactgctttatgagatattaaaggaattcttcaggctgaaaacaagtgaactcatacgattttcaaatccacacaaaaaagcaaagggcagtagtaaaggtaattatgtactttttaaaaaaggt

SEQ ID NO: 29439 - DNA, 413 bp, Homo sapiens
agctactcagaaaactgaagtgggagaattgcatgagtctaggaggcttgagcctgggaggcagaggttgcagtgagccatgatcatgctgctacactccagcctgggcaacagagcaagaccctgtctcaaaaaaaaaagaaatgtgaatgaggctgggcatggtggtgtacacctgtagtcccagctactcagaaggctgaggcaggaggatcccttgagcccaggagtttgagtccagcttggacaccatggtgagaccccatctcctaaaaaaaatcaatttaaaaaaaagggttcatgggtgtaatttcaacactttggaaggctgaggcaagaggattgcttgaagccaggcaagaggattgcttgaagccaggagttcaagacccccgtctcctcgttattaaaat

SEQ ID NO: 29440 - DNA, 377 bp, Homo sapiens
cgaacttacaccaacccttctcagacttttccaaaaaagtgaagaggaagaaaacttccaaactcattttatgatgccagcattaccctgataccaaagccagacactactggaaaagaaaactatggaacaatatcccttatgaacactgatgcaaaaattctcaacagaagactagcaaactgaattctacagcatagtaaaaggattatacaccatgacctagtagaatttattcctggaatgcaagaataattcaacatatgaagaaaaaacaatgtactataccacatcaacagaatgaagggaaaaaaatccatgatcatctccattgatgcataaaaatcatactgacaaaattctttttttcatgataa

SEQ ID NO: 29441 - DNA, 412 bp, Homo sapiens
ggccttagagcctgcccctccaccccctcagatcaggcatagccatagtcaagcccagcaggtttcctcaggagctgtctggggtgttgatggtggatgacgctgctgaacaagtttggtgactgttctaagcacaactggcttgatactgttcccacggcctgtccacctcccacccccaaccctccaccagagtaggtaggatgtagggagggtgcgtgcctcctttgctctaggcactgagggaccaagctagccgtgcacagccccatacacttcaggggactaaaggaaagagctgagccaaggaaaatcagctgagcccagggctgggggctgcttgtctgctatcctgtaccttttttttttttaaccaaaataaagattcccctcttcttgccataaaattggc

SEQ ID NO: 29442 - DNA, 313 bp, Homo sapiens
agataaggcagaaaaataaattttaataagatacacagaataatcttgtatttgaagaatgctatgaaaaaagatagtttggagcagtagttagtatttggctcatataatgtgttaggtactattctaagccattaaacatttgtatgcttaatacctaagagtttaaagtgaagaaatcaaagattcattgaaaaagaaaaattaaatttaaaaaaaattgtatttttaattgaaaaataatagttgtacatatctgtctacagtgtaatattttgatatatgtttatgttgtaaaatgattaaatcaagt

SEQ ID NO: 29443 - DNA, 1612 bp, Homo sapiens
aaaacaggtacaggaaatcccatgtggatgcttgcttccaggatttcctgccatgattccagaatcccacagctccaacatgattgcaaaagactccctgctcatttttcctcagcatgcacagcgctgtcctgtctcagttgcaactcgacagagccgcatttactccagaacccaatccacacacctgctcatcctgccccgagaggagtgcctgaagccaatagcagggaactagagcagacttgggtggatcttcattggatattaggtatcttgccctagataggcagcagtggccttacagatgctgacagatgatctgattagatgcacagttgctgggtggcgtctggggccagtctattggcagttctgggagtgggaactatttgggctctgcaaagatggtttcacctttaagaagggcagtatggggaggtgaagatggggcccaaaggatagaacatagtcaaagaagcagggccacaatgcccctttaattcccaagccctagttgggcagtgcttggtgacacatcccattacctcaccttagatcaatgtctactgagccatcattagctctgcttcctcacttcttcacagtatctgatggcccatcacatgctgctcaacatcttagaccaatgtctgctcacccattacctcccttcacctcatccagcactgtatctgaagcttcactattcttccttcagttttggatattttgtgatacaacattatccccaacttaggacaatgtcagctgactctcaggagggtgcctggagatcacctcttccttcctaacataccctagaacaaggtctggtccccttcattattcccattttaccttactcctaagtgtatcactcctcatgaattccaggaaatatggaggaaaacacatttcactgtacatgactttcaataatttctcctttatatttattgtaacgtgatattttagtgctgacatatatatgtatatgtatgcccatttatataaaagactagtttttagagaaattttaggttcacagcaaaatggggcagaaggtacagagatttcccatatatcccctaccctcacatatacacagcctcccccatcatcaacatcccccttcagagtggtacatttgttacaattgatgaaactacattgacactatcggccaaagtccatggtttaattagggttcagtcttgatgtgcattctgtgggttgagacaaatgaataatgacatgtatgcattattacagaaggataaagagccgtttcactgtcccaataatcctctgtgtttcgcctactcctctaaactcctggctattttcttttgtctccataattttgcctctgaaccataaagtatgcagccttttcagattgatttgtttcacttagtaatgtggatttaagtttcttccatgtcttttcgtagcttgctagctcttttttttttttttttctcattgaataatatgctattgtctggaagtaccatgacttatttatccattcacctactgaaggacaccttaattgcttccaagttttgttgattatgaataaagatgctataaacacctgtgtgca

SEQ ID NO: 29444 - DNA, 770 bp, Homo sapiens
  misc_feature (32)..(32): n is a, c, g, or t
  misc_feature (34)..(35): n is a, c, g, or t
  misc_feature (37)..(37): n is a, c, g, or t
  misc_feature (64)..(64): n is a, c, g, or t
  misc_feature (115)..(115): n is a, c, g, or t
gtcgatagtaaaagcatctaggatgtggagcnanngntgaaatctgctagaaagttagggggtncttatttgcattccagaatcttgactttctgattggtgattcaaagctgtngtgttcctggcctggctagacccaggacatatatatgtatatgtatgcccatttatataaaagactagtttttagagaaattttaggttcacagcaaaatggggcagaaggtacagagatttcccatatatcccctaccctcacatatacacagcctcccccatcatcaacatcccccttcagagtggtacatttgttacaattgatgaaactacattgacactatcggccaaagtccatggtttaattagggttcagtcttgatgtgcattctgtgggttgagacaaatgaataatgacatgtatgcattattacagaaggataaagagccgtttcactgtcccaataatcctctgtgtttcgcctactcctctaaactcctggctattttcttttgtctccataattttgcctctgaaccataaagtatgcagccttttcagattgatttgtttcacttagtaatgtggatttaagtttcttccatgtcttttcgtagcttgctagctcttttttttttttttttctcattgaataatatgctattgtctggaagtaccatgacttatttatccattcacctactgaaggacaccttaattgcttccaagttttgttgattatgaataaagatgctataaacacctgtgtgca

SEQ ID NO: 29445 - DNA, 784 bp, Homo sapiens
tttgtagagctggggtctcatgttgtccagactggtctccaactcctgccttagcctcccaaagctaattacaggtgtgagatgctgtgcctggcctgattttcttaatagtatttcttttctctagctaactctaagaatacagtatataatacatataacataaaatacatgttaatcgactatgttctcagtaaggcttctggtcaatagtaggctattagtaaagtttttggagaatcaaaaggtatatgcagattttcgactatgcaggggttggcgccccaactcctgtgttgttcaagggttaactgcacactcatttgggagctgcaggcaaagaacagatttgagggaatgccagatgatgaaggcagatcagatggccatacccattgtccatcagagagatgagagtagctttcaccacagtgatggtgctagagatgggaagaagtgatggattcaagaactattttgaagctaagtcaacaggccttggatgatggccatggagggagaaggagcagcttaggacaattcccagcttgagcaactggatgactggtgatgccattcactgaggctctcaagatgagggagtttttggtgagtagaacagggagggagggtagcctggctgagtttgaagggtttttcagcctccttcaaaggaggagtcaagttggcagttagatatgcaagctggagcttagaggaagatgtgagaactgtccacacataggtggtgatgggtaccccggtatgggtgagatcactagag

SEQ ID NO: 29446 - DNA, 369 bp, Homo sapiens
ttttttgcgggggggaggggtggagacagggttttgctctgctgcacaggctgcagtgctatgatgtgaacggggcttactgcagccttgccctcctgagctcaagggattcttctacctcagcctcctgagtagctgggactgcagtctcatcacactcccagctaattttttactgttttgcagagatacggtctcactatgttgcccaggctggtctccacactactcaagcaatcctcccgccgcctcagcctctcaaagtgctgggattacagtcatgagccaccgtgcccagccccactgacatcttttgaaatttaaaaaactcctgtgtgggagaatgaaaatctggaacttgacgtgaag

SEQ ID NO: 29447 - DNA, 804 bp, Homo sapiens
ggcatgaatagcctcaaaatatagttaatagtaaatagaaataaccagaaaatgatgcattttgagtacttattatctttgtttttggtataatttatttaattgtaaatttatgtaatttaatttttaatactggcactaatgggcctgcaaaattcctaaaaatttaacaactagttcttgtgggctagtaggggctggcttctgcacagatcatatagatcatctggtgtagtgattcccaaccttgctttacactgaaatacctcaaagaacttagagcccacagttttagtagatccacattagggcccaggaatctgaactaaaaacgtttttattgaagtatatcttatatttaaaaaaaaattatcagtatataacaaaaagttttcctaaattgaacacactcacataaccagcacctaaatacagaaacagaacattaccagcacccagaagcccttctcatgcccctatccagccactacccaatcaatgtaacccttatcttgacttctaataccataaattagttttgcctgcttttggactttatataaatgaaatcatatcctatgtattcttttgtgcctggcttcaatattatgtttgtgagattcatccataatgtatgcagcagtagttcattcatttttagtagtgtataatattccattgtataaatagtcctcaatttattatttttaatccattttactgttgatgggttgtttccagttgttggctgttttggatagtgctgccaagaacattcttgtacagatagcagtatgcaaaaca

SEQ ID NO: 29448 - DNA, 743 bp, Homo sapiens
gacataccctgacgatttctcactgacaggcaattttctaggactaaagaggaaaagatagcattgcatcctcgcatctgcagtgcattacaggggtgcatttagacattctttctcccagtagattgtgagctccgtgatggtgaagaccatataccatgtgtctcttattcaattctcaacacgcatttgttgagcacctactatcttcttggcacccagtaggggttgagcaacacaatagaagtgctctgtaaatatttatggttggaagataggtagatgccccaggagaaaagacatgggagtttctaggcagggccttgggttttaaattgccaaaaaattttctctcctctgttgatttgaatatggtccggtccctagtaaaagcttgatattagcctagtgatgtggtggaaagaactttggattaaaattaggaaaaccaggttctagtaccaactgtgctgagaacttacataaagctggccaagtggcttccctagtcttggcctcagtttacctactgtaaatttttaaatgattgggttaagtggtcctaactcttaacttaagagccttacctgcacttctgttgtgtgattttttgaggtgggtgactgaattccttctaattgtgaactctacctgagccaaactcttacctttgtcgtcatccttatggcaaccaacactagtcccagaccatgctgaaaaatatctgcctgtttgacttgcac

SEQ ID NO: 29449 - DNA, 1662 bp, Homo sapiens
acgctcccctttcacctcgcggccgtaggctaacgtggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagcgcggcggctgcggcggcggcggcggcgggcgctggaggcctgtgagagccgcagcccggagcgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtct

SEQ ID NO: 29450 - DNA, 7177 bp, Homo sapiens
acgctcccctttcacctcgcggccgtaggctaacgtggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagcgcggcggctgcggcggcggcggcggcgggcgctggaggcctgtgagagccgcagcccggagcgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgttaccgtaactagaaccttgctttgtgaactgtctttcattgggatgtatggtttctctcaatgtgaaatctggaaacttcatgtaaactacccatgccgttatttcatgtgactccagtgcccttgtattccataacatgctgatgagagggatttctcacggtttctttctttgctaaattttttaaccataaagcagcttaccctttattttcccatcttggaagtaaaattgaccaaagaatgtacgttctagcctggtggaatgtgcatactttaggtttgtatgttacattgtccaaagccctttactttcttattagtaaactgaatctaatatgacacaaatgttttcacccaatctcttgcaactggtcaaattcgagaaggtgttgggccttagcagtaggccttttcagtgaaaattcattcaaagttttggtaggtggaacacttgatatttaaataggacttgaaaattttgaaaagagtatcagagacctcatttttttcctttgcaataagctgaagaaactttctttttcaggagagatggcaaaggtatatgctgttgccagagtcctgtggtataagcatctgtttttattatagtatgtcaaagttagggaaatgggactggcaagtaaaaaatggaatttaatttcaatgttttatgggaactctgatttaatgggaagcaaactagttcatattagcaggaattattttattttttcgagacagagtttcactctcgttggccaggctggagtgcaatggcgtgatctcggctcaccgcaacctctgcttcccgggttcaagcgattctcctgcctcagcctcccaagtagctgggattacaggcatacaccaccacacccagctaatttttttgtatttttgttagagacagggtttctccatgttggtcaggctggtctcgaactcccgacctcaggtgatccgcccacctcggcctcccaaagtgatgattttatttttatttttaattgtattaatctgcatctagataatgactttgtgaagggtgtgtgttgtgtgcaaaacttaaggtattggttgagagttaaatacattatttttataatatgttgggtatagtctagttactaatgattttttttaagtacttttataaaaagttcatttttaaaattgtttgtttttaaaagccaatatacgttgcagaattaggaacagtatttatatttatttacacaagacattgtgccatagcatcctagtaaaacaccttcatgaatgagtaatgttatctcccagaattacattaaaattatttctaaaaagtagcaaagtcattaccttttgcttttaatgacccacacctcaccagctcctggtcttttcttcactgttgcccttattttgaggcaatttttcttaaaatatgacttttatgcaccacatttagtagaggcagtgacatcagtgatctcagtacccatcagctgtccccctcctctgcccttcttcatctcttctaccttgtgaccatttcccttaccggttcatgttctcctttatctctgcttttctttcttagccaggatacttccctcacaactctcactcccaaattcttttagatatacatttttctggatattggctgctgaaatctgaagctctggtaaagttcctagtatcagagatcaatcctggaggaggcctagttcactattagattacaaagactcctcacaaagtaaaggaaaatcaccttcaaaaccacaaccctttatgttgtcaagtctaatatgagtgtttttacgaagtatttctttctacccattgttcaagaatgtaaatgtgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcataacctagcatttacaactaaagtatgttttttataagaactggcatcttgatgtatataggtctgaaataatatttcatcttttgatttttaattttaataatattagaccaggatagatcacagttttacaaatcttagttttaaataaattatttcagtgtgctgttagtcctctacagtcattttggtttaaaaagtgactatttatttatggtagcatatcaataatttattaatgttaaaaaatactgtgtatgacattacaaaccagaacagttcctgggggagaggattctaattgattggcagttctgagagggcaagaagaatggaactttatacttcaaaaggaggttttggttttaccaggtactgcttatgtaaatcgtttatttttatttcatcaaagcctggcaagtatatgcattccaatttaccattggcaaagctttatttatttttaaggttggatgttgaattaattttgtgggaaaatgagatttgtaagtagttttctttctagataagataacataaaccaaactttcagaagttaaggatgatgaataatattgaaatgacttgttatatattgtaagggttcccttaagtatcataattaacaatttgtggaaattgaaaaagcataaactgtgttatttgattagtaatatgttcccttaaaattcattttgaggtgtatgttatacacacagtaaatttttgttcaggaatgacttgctcattctgtgtttttaaaaataggaaataaggcatagtgagtcatcattacatcaattaaccaaaaaatatttcatcccctccgtcactgaaattatctacttcagccacctttcttattctcgtgttaggagggcacgtttatggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttggtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaa

SEQ ID NO: 29451 - DNA, 7122 bp, Homo sapiens
acgctcccctttcacctcgcggccgtaggctaacgtggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagcgcggcggctgcggcggcggcggcggcgggcgctggaggcctgtgagagccgcagcccggagcgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgttaccgtaactagaaccttgctttgtgaactgtctttcattgggatgtatggtttctctcaatgtgaaatctggaaacttcatgtaaactacccatgccgttatttcatgtgactccagtgcccttgtattccataacatgctgatgagagggatttctcacggtttctttctttgctaaattttttaaccataaagcagcttaccctttattttcccatcttggaagtaaaattgaccaaagaatgtacgttctagcctggtggaatgtgcatactttaggtttgtatgttacattgtccaaagccctttactttcttattagtaaactgaatctaatatgacacaaatgttttcacccaatctcttgcaactggtcaaattcgagaaggtgttgggccttagcagtaggccttttcagtgaaaattcattcaaagttttggtaggtggaacacttgatatttaaataggacttgaaaattttgaaaagagtatcagagacctcatttttttcctttgcaataagctgaagaaactttctttttcaggagagatggcaaaggtatatgctgttgccagagtcctgtggtataagcatctgtttttattatagtatgtcaaagttagggaaatgggactggcaacaaactagttcatattagcaggaattattttattttttcgagacagagtttcactctcgttggccaggctggagtgcaatggcgtgatctcggctcaccgcaacctctgcttcccgggttcaagcgattctcctgcctcagcctcccaagtagctgggattacaggcatacaccaccacacccagctaatttttttgtatttttgttagagacagggtttctccatgttggtcaggctggtctcgaactcccgacctcaggtgatccgcccacctcggcctcccaaagtgatgattttatttttatttttaattgtattaatctgcatctagataatgactttgtgaagggtgtgtgttgtgtgcaaaacttaaggtattggttgagagttaaatacattatttttataatatgttgggtatagtctagttactaatgattttttttaagtacttttataaaaagttcatttttaaaattgtttgtttttaaaagccaatatacgttgcagaattaggaacagtatttatatttatttacacaagacattgtgccatagcatcctagtaaaacaccttcatgaatgagtaatgttatctcccagaattacattaaaattatttctaaaaagtagcaaagtcattaccttttgcttttaatgacccacacctcaccagctcctggtcttttcttcactgttgcccttattttgaggcaatttttcttaaaatatgacttttatgcaccacatttagtagaggcagtgacatcagtgatctcagtacccatcagctgtccccctcctctgcccttcttcatctcttctaccttgtgaccatttcccttaccggttcatgttctcctttatctctgcttttctttcttagccaggatacttccctcacaactctcactcccaaattcttttagatatacatttttctggatattggctgctgaaatctgaagctctggtaaagttcctagtatcagagatcaatcctggaggaggcctagttcactattagattacaaagactcctcacaaagtaaaggaaaatcaccttcaaaaccacaaccctttatgttgtcaagtctaatatgagtgtttttacgaagtatttctttctacccattgttcaagaatgtaaatgtgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcataacctagcatttacaactaaagtatgttttttataagaactggcatcttgatgtatataggtctgaaataatatttcatcttttgatttttaattttaataatattagaccaggatagatcacagttttacaaatcttagttttaaataaattatttcagtgtgctgttagtcctctacagtcattttggtttaaaaagtgactatttatttatggtagcatatcaataatttattaatgttaaaaaatactgtgtatgacattacaaaccagaacagttcctgggggagaggattctaattgattggcagttctgagagggcaagaagaatggaactttatacttcaaaaggaggttttggttttaccaggtactgcttatgtaaatcgtttatttttatttcatcaaagcctggcaagtatatgcattccaatttaccattggcaaagctttatttatttttaaggttggatgttgaattaattttgtgggaaaatgagatttgtaagtagttttctttctagataagataacataaaccaaactttcagaagttaaggatgatgaataatattgaaatgacttgttatatattgtaagggttcccttaagtatcataattaacaatttgtggaaattgaaaaagcataaactgtgttatttgattagtaatatgttcccttaaaattcattttgaggtgtatgttatacacacagtaaatttttgttcaggaatgacttgctcattctgtgtttttaaaaataggaaataaggcatagtgagtcatcattacatcaattaaccaaaaaatatttcatcccctccgtcactgaaattatctacttcagccacctttcttattctcgtgttaggagggcacgtttatggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttggtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaa

SEQ ID NO: 29452 - DNA, 7116 bp, Homo sapiens
acgctcccctttcacctcgcggccgtaggctaacgtggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagccgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgttaccgtaactagaaccttgctttgtgaactgtctttcattgggatgtatggtttctctcaatgtgaaatctggaaacttcatgtaaactacccatgccgttatttcatgtgactccagtgcccttgtattccataacatgctgatgagagggatttctcacggtttctttctttgctaaattttttaaccataaagcagcttaccctttattttcccatcttggaagtaaaattgaccaaagaatgtacgttctagcctggtggaatgtgcatactttaggtttgtatgttacattgtccaaagccctttactttcttattagtaaactgaatctaatatgacacaaatgttttcacccaatctcttgcaactggtcaaattcgagaaggtgttgggccttagcagtaggccttttcagtgaaaattcattcaaagttttggtaggtggaacacttgatatttaaataggacttgaaaattttgaaaagagtatcagagacctcatttttttcctttgcaataagctgaagaaactttctttttcaggagagatggcaaaggtatatgctgttgccagagtcctgtggtataagcatctgtttttattatagtatgtcaaagttagggaaatgggactggcaagtaaaaaatggaatttaatttcaatgttttatgggaactctgatttaatgggaagcaaactagttcatattagcaggaattattttattttttcgagacagagtttcactctcgttggccaggctggagtgcaatggcgtgatctcggctcaccgcaacctctgcttcccgggttcaagcgattctcctgcctcagcctcccaagtagctgggattacaggcatacaccaccacacccagctaatttttttgtatttttgttagagacagggtttctccatgttggtcaggctggtctcgaactcccgacctcaggtgatccgcccacctcggcctcccaaagtgatgattttatttttatttttaattgtattaatctgcatctagataatgactttgtgaagggtgtgtgttgtgtgcaaaacttaaggtattggttgagagttaaatacattatttttataatatgttgggtatagtctagttactaatgattttttttaagtacttttataaaaagttcatttttaaaattgtttgtttttaaaagccaatatacgttgcagaattaggaacagtatttatatttatttacacaagacattgtgccatagcatcctagtaaaacaccttcatgaatgagtaatgttatctcccagaattacattaaaattatttctaaaaagtagcaaagtcattaccttttgcttttaatgacccacacctcaccagctcctggtcttttcttcactgttgcccttattttgaggcaatttttcttaaaatatgacttttatgcaccacatttagtagaggcagtgacatcagtgatctcagtacccatcagctgtccccctcctctgcccttcttcatctcttctaccttgtgaccatttcccttaccggttcatgttctcctttatctctgcttttctttcttagccaggatacttccctcacaactctcactcccaaattcttttagatatacatttttctggatattggctgctgaaatctgaagctctggtaaagttcctagtatcagagatcaatcctggaggaggcctagttcactattagattacaaagactcctcacaaagtaaaggaaaatcaccttcaaaaccacaaccctttatgttgtcaagtctaatatgagtgtttttacgaagtatttctttctacccattgttcaagaatgtaaatgtgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcataacctagcatttacaactaaagtatgttttttataagaactggcatcttgatgtatataggtctgaaataatatttcatcttttgatttttaattttaataatattagaccaggatagatcacagttttacaaatcttagttttaaataaattatttcagtgtgctgttagtcctctacagtcattttggtttaaaaagtgactatttatttatggtagcatatcaataatttattaatgttaaaaaatactgtgtatgacattacaaaccagaacagttcctgggggagaggattctaattgattggcagttctgagagggcaagaagaatggaactttatacttcaaaaggaggttttggttttaccaggtactgcttatgtaaatcgtttatttttatttcatcaaagcctggcaagtatatgcattccaatttaccattggcaaagctttatttatttttaaggttggatgttgaattaattttgtgggaaaatgagatttgtaagtagttttctttctagataagataacataaaccaaactttcagaagttaaggatgatgaataatattgaaatgacttgttatatattgtaagggttcccttaagtatcataattaacaatttgtggaaattgaaaaagcataaactgtgttatttgattagtaatatgttcccttaaaattcattttgaggtgtatgttatacacacagtaaatttttgttcaggaatgacttgctcattctgtgtttttaaaaataggaaataaggcatagtgagtcatcattacatcaattaaccaaaaaatatttcatcccctccgtcactgaaattatctacttcagccacctttcttattctcgtgttaggagggcacgtttatggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttggtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaa

SEQ ID NO: 29453 - DNA, 7317 bp, Homo sapiens
acgctcccctttcacctcgcggccgtaggctaacgtggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagcgcggcggctgcggcggcggcggcggcgggcgctggaggcctgtgagagccgcagcccggagcgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgttaccgtaactagaaccttgctttgtgaactgtctttcattgggatgtatggtttctctcaatgtgaaatctggaaacttcatgtaaactacccatgccgttatttcatgtgactccagtgcccttgtattccataacatgctgatgagagggatttctcacggtttctttctttgctaaattttttaaccataaagcagcttaccctttattttcccatcttggaagtaaaattgaccaaagaatgtacgttctagcctggtggaatgtgcatactttaggtttgtatgttacattgtccaaagccctttactttcttattagtaaactgaatctaatatgacacaaatgttttcacccaatctcttgcaactggtcaaattcgagaaggtgttgggccttagcagtaggccttttcagtgaaaattcattcaaagttttggtaggtggaacacttgatatttaaataggacttgaaaattttgaaaagagtatcagagacctcatttttttcctttgcaataagctgaagaaactttctttttcaggagagatggcaaaggtatatgctgttgccagagtcctgtggtataagcatctgtttttattatagtatgtcaaagttagggaaatgggactggcaagtaaaaaatggaatttaatttcaatgttttatgggaactctgatttaatgggaagcaaactagttcatattagcaggaattattttattttttcgagacagagtttcactctcgttggccaggctggagtgcaatggcgtgatctcggctcaccgcaacctctgcttcccgggttcaagcgattctcctgcctcagcctcccaagtagctgggattacaggcatacaccaccacacccagctaatttttttgtatttttgttagagacagggtttctccatgttggtcaggctggtctcgaactcccgacctcaggtgatccgcccacctcggcctcccaaagtgatgattttatttttatttttaattgtattaatctgcatctagataatgactttgtgaagggtgtgtgttgtgtgcaaaacttaaggtattggttgagagttaaatacattatttttataatatgttgggtatagtctagttactaatgattttttttaagtacttttataaaaagttcatttttaaaattgtttgtttttaaaagccaatatacgttgcagaattaggaacagtatttatatttatttacacaagacattgtgccatagcatcctagtaaaacaccttcatgaatgagtaatgttatctcccagaattacattaaaattatttctaaaaagtagcaaagtcattaccttttgcttttaatgacccacacctcaccagctcctggtcttttcttcactgttgcccttattttgaggcaatttttcttaaaatatgacttttatgcaccacatttagtagaggcagtgacatcagtgatctcagtacccatcagctgtccccctcctctgcccttcttcatctcttctaccttgtgaccatttcccttaccggttcatgttctcctttatctctgcttttctttcttagccaggatacttccctcacaactctcactcccaaattcttttagatatacatttttctggatattggctgctgaaatctgaagctctggtaaagttcctagtatcagagatcaatcctggaggaggcctagttcactattagattacaaagactcctcacaaagtaaaggaaaatcaccttcaaaaccacaaccctttatgttgtcaagtctaatatgagtgtttttacgaagtatttctttctacccattgttcaagaatgtaaatgtgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcataacctagcatttacaactaaagtatgttttttataagaactggcatcttgatgtatataggtctgaaataatatttcatcttttgatttttaattttaataatattagaccaggatagatcacagttttacaaatcttagttttaaataaattatttcagtgtgctgttagtcctctacagtcattttggtttaaaaagtgactatttatttatggtagcatatcaataatttattaatgttaaaaaatactgtgtatgacattacaaaccagaacagttcctgggggagaggattctaattgattggcagttctgagagggcaagaagaatggaactttatacttcaaaaggaggttttggttttaccaggtactgcttatgtaaatcgtttatttttatttcatcaaagcctggcaagtatatgcattccaatttaccattggcaaagctttatttatttttaaggttggatgttgaattaattttgtgggaaaatgagatttgtaagtagttttctttctagataagataacataaaccaaactttcagaagttaaggatgatgaataatattgaaatgacttgttatatattgtaagggttcccttaagtatcataattaacaatttgtggaaattgaaaaagcataaactgtgttatttgattagtaatatgttcccttaaaattcattttgaggtgtatgttatacacacagtaaatttttgttcaggaatgacttgctcattctgtgtttttaaaaataggaaataaggcatagtgagtcatcattacatcaattaaccaaaaaatatttcatcccctccgtcactgaaattatctacttcagccacctttcttattctcgtgttaggagggcacgtttatggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttggtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaaaaaaaaaaaaaaaaaaattgggggcgggcgaaaaattttaaacatgtgggggggggcaatgaaagaaggcaggtccaagacggggaagggggtcacaaaaagcggggggttgaaaagggggggtggtataggtaacgggg

SEQ ID NO: 29454 - DNA, 7149 bp, Homo sapiens
acgctcccctttcacctcgcggccgtaggctaacgtggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagcgcggcggctgcggcggcggcggcggcgggcgctggaggcctgtgagagccgcagcccggagcgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggctggggcaggagaatcgcttgaacccgagaggtggaggttgcagtgagccaagatcgcgctgttgcactccagcctgagtgacagagcgagactctgtctcaaaaaataaataaataaataaaaataaacaataagttactttgcaatgtatttttgttctgagtttaatgtttatacagttactttaaaatttttttaatttgaaataattttaaacttaagcagttgcagagactgcagcaagctcctgcacactccatcctgctattttaacaggatacttaatcaaaaaagtatgctactttcttaaaattttttgaataataacctaaattctttgtttatcttttaggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgttaccgtaactagaaccttgctttgtgaactgtctttcattgggatgtatggtttctctcaatgtgaaatctggaaacttcatgtaaactacccatgccgttatttcatgtgactccagtgcccttgtattccataacatgctgatgagagggatttctcacggtttctttctttgctaaattttttaaccataaagcagcttaccctttattttcccatcttggaagtaaaattgaccaaagaatgtacgttctagcctggtggaatgtgcatactttaggtttgtatgttacattgtccaaagccctttactttcttattagtaaactgaatctaatatgacacaaatgttttcacccaatctcttgcaactggtcaaattcgagaaggtgttgggccttagcagtaggccttttcagtgaaaattcattcaaagttttggtaggtggaacacttgatatttaaataggacttgaaaattttgaaaagagtatcagagacctcatttttttcctttgcaataagctgaagaaactttctttttcaggagagatggcaaaggtatatgctgttgccagagtcctgtggtataagcatctgtttttattatagtatgtcaaagttagggaaatgggactggcaagtaaaaaatggaatttaatttcaatgttttatgggaactctgatttaatgggaagcaaactagttcatattagcaggaattattttattttttcgagacagagtttcactctcgttggccaggctggagtgcaatggcgtgatctcggctcaccgcaacctctgcttcccgggttcaagcgattctcctgcctcagcctcccaagtagctgggattacaggcatacaccaccacacccagctaatttttttgtatttttgttagagacagggtttctccatgttggtcaggctggtctcgaactcccgacctcaggtgatccgcccacctcggcctcccaaagtgatgattttatttttatttttaattgtattaatctgcatctagataatgactttgtgaagggtgtgtgttgtgtgcaaaacttaaggtattggttgagagttaaatacattatttttataatatgttgggtatagtctagttactaatgattttttttaagtacttttataaaaagttcatttttaaaattgtttgtttttaaaagccaatatacgttgcagaattaggaacagtatttatatttatttacacaagacattgtgccatagcatcctagtaaaacaccttcatgaatgagtaatgttatctcccagaattacattaaaattatttctaaaaagtagcaaagtcattaccttttgcttttaatgacccacacctcaccagctcctggtcttttcttcactgttgcccttattttgaggcaatttttcttaaaatatgacttttatgcaccacatttagtagaggcagtgacatcagtgatctcagtacccatcagctgtccccctcctctgcccttcttcatctcttctaccttgtgaccatttcccttaccggttcatgttctcctttatctctgcttttctttcttagccaggatacttccctcacaactctcactcccaaattcttttagatatacatttttctggatattggctgctgaaatctgaagctctggtaaagttcctagtatcagagatcaatcctggaggaggcctagttcactattagattacaaagactcctcacaaagtaaaggaaaatcaccttcaaaaccacaaccctttatgttgtcaagtctaatatgagtgtttttacgaagtatttctttctacccattgttcaagaatgtaaatgtgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcataacctagcatttacaactaaagtatgttttttataagaactggcatcttgatgtatataggtctgaaataatatttcatcttttgatttttaattttaataatattagaccaggatagatcacagttttacaaatcttagttttaaataaattatttcagtgtgctgttagtcctctacagtcattttggtttaaaaagtgactatttatttatggtagcatatcaataatttattaatgttaaaaaatactgtgtatgacattacaaaccagaacagttcctgggggagaggattctaattgattggcagttctgagagggcaagaagaatggaactttatacttcaaaaggaggttttggttttaccaggtactgcttatgtaaatcgtttatttttatttcatcaaagcctggcaagtatatgcattccaatttaccattggcaaagctttatttatttttaaggttggatgttgaattaattttgtgggaaaatgagatttgtaagtagttttctttctagataagataacataaaccaaactttcagaagttaaggatgatgaataatattgaaatgacttgttatatattgtaagggttcccttaagtatcataattaacaatttgtggaaattgaaaaagcataaactgtgttatttgattagtaatatgttcccttaaaattcattttgaggtgtatgttatacacacagtaaatttttgttcaggaatgacttgctcattctgtgtttttaaaaataggaaataaggcatagtgagtcatcattacatcaattaaccaaaaaatatttcatcccctccgtcactgaaattatctacttcagccacctttcttattctcgtgttaggagggcacgtttatggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttggtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaa

SEQ ID NO: 29455 - DNA, 7256 bp, Homo sapiens
acgctcccctttcacctcgcggccgtaggctaacgtggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagcgcggcggctgcggcggcggcggcggcgggcgctggaggcctgtgagagccgcagcccggagcgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgttaccgtaactagaaccttgctttgtgaactgtctttcattgggatgtatggtttctctcaatgtgaaatctggaaacttcatgtaaactacccatgccgttatttcatgtgactccagtgcccttgtattccataacatgctgatgagagggatttctcacggtttctttctttgctaaattttttaaccataaagcagcttaccctttattttcccatcttggaagtaaaattgaccaaagaatgtacgttctagcctggtggaatgtgcatactttaggtttgtatgttacattgtccaaagccctttactttcttattagtaaactgaatctaatatgacacaaatgttttcacccaatctcttgcaactggtcaaattcgagaaggtgttgggccttagcagtaggccttttcagtgaaaattcattcaaagttttggtaggtggaacacttgatatttaaataggacttgaaaattttgaaaagagtatcagagacctcatttttttcctttgcaataagctgaagaaactttctttttcaggagagatggcaaaggtatatgctgttgccagagtcctgtggtataagcatctgtttttattatagtatgtcaaagttagggaaatgggactggcaagtaaaaaatggaatttaatttcaatgttttatgggaactctgatttaatgggaagcaaactagttcatattagcaggaattattttattttttcgagacagagtttcactctcgttggccaggctggagtgcaatggcgtgatctcggctcaccgcaacctctgcttcccgggttcaagcgattctcctgcctcagcctcccaagtagctgggattacaggcatacaccaccacacccagctaatttttttgtatttttgttagagacagggtttctccatgttggtcaggctggtctcgaactcccgacctcaggtgatccgcccacctcggcctcccaaagtgatgattttatttttatttttaattgtattaatctgcatctagataatgactttgtgaagggtgtgtgttgtgtgcaaaacttaaggtattggttgagagttaaatacattatttttataatatgttgggtatagtctagttactaatgattttttttaagtacttttataaaaagttcatttttaaaattgtttgtttttaaaagccaatatacgttgcagaattaggaacagtatttatatttatttacacaagacattgtgccatagcatcctagtaaaacaccttcatgaatgagtaatgttatctcccagaattacattaaaattatttctaaaaagtagcaaagtcattaccttttgcttttaatgacccacacctcaccagctcctggtcttttcttcactgttgcccttattttgaggcaatttttcttaaaatatgacttttatgcaccacatttagtagaggcagtgacatcagtgatctcagtacccatcagctgtccccctcctctgcccttcttcatctcttctaccttgtgaccatttcccttaccggttcatgttctcctttatctctgcttttctttcttagccaggatacttccctcacaactctcactcccaaattcttttagatatacatttttctggatattggctgctgaaatctgaagctctggtaaagttcctagtatcagagatcaatcctggaggaggcctagttcactattagattacaaagactcctcacaaagtaaaggaaaatcaccttcaaaaccacaaccctttatgttgtcaagtctaatatgagtgtttttacgaagtatttctttctacccattgttcaagaatgtaaatgtgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcataacctagcatttacaactaaagtatgttttttataagaactggcatcttgatgtatataggtctgaaataatatttcatcttttgatttttaattttaataatattagaccaggatagatcacagttttacaaatcttagttttaaataaattatttcagtgtgctgttagtcctctacagtcattttggtttaaaaagtgactatttatttatggtagcatatcaataatttattaatgttaaaaaatactgtgtatgacattacaaaccagaacagttcctgggggagaggattctaattgattggcagttctgagagggcaagaagaatggaactttatacttcaaaaggaggttttggttttaccaggtactgcttatgtaaatcgtttatttttatttcatcaaagcctggcaagtatatgcattccaatttaccattggcaaagctttatttatttttaaggttggatgttgaattaattttgtgggaaaatgagatttgtaagtagttttctttctagataagataacataaaccaaactttcagaagttaaggatgatgaataatattgaaatgacttgttatatattgtaagggttcccttaagtatcataattaacaatttgtggaaattgaaaaagcataaactgtgttatttgattagtaatatgttcccttaaaattcattttgaggtgtatgttatacacacagtaaatttttgttcaggaatgacttgctcattctgtgtttttaaaaataggaaataaggcatagtgagtcatcattacatcaattaaccaaaaaatatttcatcccctccgtcactgaaattatctacttcagccacctttcttattctcgtgttaggagggcacgtttatggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttggtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatataaccaggatgtgtgatatgtggtggttcaggcataatttccaatcttgcggattattggcaagaaatgattttgataatgggtgttcaaaaaaaagggggggaataccaggggaaggcaccttgaagccaaaaggtaaaagggggtaaggaaaggtggacatggtggacacaccagaaatttgtgtgtggataaaataagttgcca

SEQ ID NO: 29456 - DNA, 5665 bp, Homo sapiens
tcaactttctacacgcttcaatttctacccacgggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgttaccgtaactagaaccttgctttgtgaactgtctttcattgggatgtatggtttctctcaatgtgaaatctggaaacttcatgtaaactacccatgccgttatttcatgtgactccagtgcccttgtattccataacatgctgatgagagggatttctcacggtttctttctttgctaaattttttaaccataaagcagcttaccctttattttcccatcttggaagtaaaattgaccaaagaatgtacgttctagcctggtggaatgtgcatactttaggtttgtatgttacattgtccaaagccctttactttcttattagtaaactgaatctaatatgacacaaatgttttcacccaatctcttgcaactggtcaaattcgagaaggtgttgggccttagcagtaggccttttcagtgaaaattcattcaaagttttggtaggtggaacacttgatatttaaataggacttgaaaattttgaaaagagtatcagagacctcatttttttcctttgcaataagctgaagaaactttctttttcaggagagatggcaaaggtatatgctgttgccagagtcctgtggtataagcatctgtttttattatagtatgtcaaagttagggaaatgggactggcaagtaaaaaatggaatttaatttcaatgttttatgggaactctgatttaatgggaagcaaactagttcatattagcaggaattattttattttttcgagacagagtttcactctcgttggccaggctggagtgcaatggcgtgatctcggctcaccgcaacctctgcttcccgggttcaagcgattctcctgcctcagcctcccaagtagctgggattacaggcatacaccaccacacccagctaatttttttgtatttttgttagagacagggtttctccatgttggtcaggctggtctcgaactcccgacctcaggtgatccgcccacctcggcctcccaaagtgatgattttatttttatttttaattgtattaatctgcatctagataatgactttgtgaagggtgtgtgttgtgtgcaaaacttaaggtattggttgagagttaaatacattatttttataatatgttgggtatagtctagttactaatgattttttttaagtacttttataaaaagttcatttttaaaattgtttgtttttaaaagccaatatacgttgcagaattaggaacagtatttatatttatttacacaagacattgtgccatagcatcctagtaaaacaccttcatgaatgagtaatgttatctcccagaattacattaaaattatttctaaaaagtagcaaagtcattaccttttgcttttaatgacccacacctcaccagctcctggtcttttcttcactgttgcccttattttgaggcaatttttcttaaaatatgacttttatgcaccacatttagtagaggcagtgacatcagtgatctcagtacccatcagctgtccccctcctctgcccttcttcatctcttctaccttgtgaccatttcccttaccggttcatgttctcctttatctctgcttttctttcttagccaggatacttccctcacaactctcactcccaaattcttttagatatacatttttctggatattggctgctgaaatctgaagctctggtaaagttcctagtatcagagatcaatcctggaggaggcctagttcactattagattacaaagactcctcacaaagtaaaggaaaatcaccttcaaaaccacaaccctttatgttgtcaagtctaatatgagtgtttttacgaagtatttctttctacccattgttcaagaatgtaaatgtgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcataacctagcatttacaactaaagtatgttttttataagaactggcatcttgatgtatataggtctgaaataatatttcatcttttgatttttaattttaataatattagaccaggatagatcacagttttacaaatcttagttttaaataaattatttcagtgtgctgttagtcctctacagtcattttggtttaaaaagtgactatttatttatggtagcatatcaataatttattaatgttaaaaaatactgtgtatgacattacaaaccagaacagttcctgggggagaggattctaattgattggcagttctgagagggcaagaagaatggaactttatacttcaaaaggaggttttggttttaccaggtactgcttatgtaaatcgtttatttttatttcatcaaagcctggcaagtatatgcattccaatttaccattggcaaagctttatttatttttaaggttggatgttgaattaattttgtgggaaaatgagatttgtaagtagttttctttctagataagataacataaaccaaactttcagaagttaaggatgatgaataatattgaaatgacttgttatatattgtaagggttcccttaagtatcataattaacaatttgtggaaattgaaaaagcataaactgtgttatttgattagtaatatgttcccttaaaattcattttgaggtgtatgttatacacacagtaaatttttgttcaggaatgacttgctcattctgtgtttttaaaaataggaaataaggcatagtgagtcatcattacatcaattaaccaaaaaatatttcatcccctccgtcactgaaattatctacttcagccacctttcttattctcgtgttaggagggcacgtttatggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttggtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaa

SEQ ID NO: 29457 - DNA, 2617 bp, Homo sapiens
acgctcccctttcacctcgcggccgtaggctaacgtggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagcgcggcggctgcggcggcggcggcggcgggcgctggaggcctgtgagagccgcagcccggagcgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgtaactgattgggatcctctagaatgccc

SEQ ID NO: 29458 - DNA, 1147 bp, Homo sapiens
acgctcccctttcacctcgcggccgtaggctaacgtggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagcgcggcggctgcggcggcggcggcggcgggcgctggaggcctgtgagagccgcagcccggagcgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggttataaagttttcgcacttttgacggccatcgtgcgggggtcc

SEQ ID NO: 29459 - DNA, 599 bp, Homo sapiens
accggtccggctatacattatctagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttggtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaa

SEQ ID NO: 29460 - DNA, 528 bp, Homo sapiens
gcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccaggtgggagcccacgggcggagcgcccactcgagccgggtagcgcgtctcggcccgtcgactcttaacagtatgggatgtggagcttctggttccattttgtagatgtggaaattgagacgcagaagttaacgtgcacaaggtcagacagacagcagaggagctgggtgaggttgcacgtagtctgactcagggcccgtgcccttttggctcgtcctgggtcgggtgtgcgccgtgtgtacctgggatcagaaggccttgaaacgaaaaggctgacaaagttaattgcacccgcagctt

SEQ ID NO: 29461 - DNA, 243 bp, Homo sapiens
caaaaccacaaccctttatgttgtcaagtctaatatgagtgtttttacgaagtatttctttctacccattgttcaagaatgtaaatgtaaaaaaaaatacaagagagttgggtagatatgcatgcttgaggaaacttgcttttacgtgttttcctacttgtatccccagttcagttgaatttacaaggacctacaagatggtcatgtttgtcttggtatgtgctaccccaattttagtgtttc

SEQ ID NO: 29462 - DNA, 373 bp, Homo sapiens
ttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaagagatggtgtgctgcatctgct

SEQ ID NO: 29463 - DNA, 480 bp, Homo sapiens
gcaactgccttctgggaagggcacagcctagaaagggactcagctgtgagccatttcagcctccgatattcctggaggctgggggaacaagcgcctcctccacaaaagggatctgggcaacatagcactgcatctaccctcgatggcaagtggggcacaggaccataggcaagtgtttcagagcgactagaaccccctacagagagtgccaggccgagcatggtggctcacacctataatcccagcactttgggaagccaaggctggcagatcacttgaggtctgaagttcgagaccagcctggccaacatggtgaaaccctgtctctactaaaaatacaaaaattagccacgcctgtaatcccagctactcaggaggctgaggcacaagaatctcttgaacccgggaggctgaggttgcagtgagcagagatcgcgccaccgcactccagcctgggcgacagagtgagactcgatctca

SEQ ID NO: 29464 - DNA, 442 bp, Homo sapiens
gaaacggagtctcgctctgtcacccagactggagtgcaatggcacgatctccactcactgcaacctctgcttcccgggttcaagcgattctcctgcccaagcctcctgagtagctgggattacaggcacacaccaccacgcccggctaattttttgtaactttagtagagacgaggtttccccatattggccaggctgctctggaactcctgaccttgtgatctgcccaccttggccaagaaatctctttaagtattcatttgtactttaaggtaatgctcgatctcgctcttagtacagctgaattgtccttcaaaaagatgatctggttatgtttgacctcttcctcaagggaccaaaaagggaagttctcagctttttatagtatgaggtccctagaggttttcactttggggatttaaaaacaagtttcctgtagcta

SEQ ID NO: 29465 - DNA, 359 bp, Homo sapiens
aattaacattttaacgtaaaacattttctacataatacctgccacaatgtcaaatgagtttggaaaatacccttttaacctaaaggcattctgggaacaagaaaagccttaagtgttttgaatggaggagttttatttaattaagatttctaatggaaagagcaaatttgtaatttgatacctataattttattttatattttattgtttctaagaataatttttgttttactagagatggggtagtgataattgcatcctaccctttcttttttttttgagatgggaatcttgcagtgagccgagatcacaccattgcactccaccttggggcaacaaaaggcaaaactctgtcttca

SEQ ID NO: 29466 - DNA, 709 bp, Homo sapiens
gttcagacctttcctctacacggtgggatccactagattctcatctgaaagagctgcatacccttaggccaaaaccaggatattttgctggtgagacggctagctccacacatggtcatcccagccagaggagctgcccagtacccagatgagaaagaggtcttggtggctgacgacgcaaggtggggctggtacagcgggaactttgcagtttctgtgaaagctagccttggagcatgtgacccacactgccttggctggaaccagaagtcaaacgcctggggggtgttggggctgccagaagaggagtggctgcagagacctggagcgccccactaccaaacccctcacaaccgagtgtcccacccacctctctcatctcaggcccctctacctccccccaaacgtttccctcccaaaatcaagtttcagagtagaagactttggagaccaagtcccactcccattgaacagatgggccactgaggccaggagggaagctgccccccaccagccagcactgtgtcaccactcacttgcctgcaccacagcgccaggtgttaggccaggccagcagtttcccagaccggtgctcctgtttcctaagatgtctgccaggtgatcagccaccccgcatttgcctcagcggtggaagaaaaacaagtatttactggagggaatggaaggccccaactctccttaaaaaaaa

SEQ ID NO: 29467 - DNA, 411 bp, Homo sapiens
cctcagccccggtggaccccagagccagcaggcccttcagaatggaaggtgccaaacaccatcggaaggcgtggttcttttcagagaaccagactctgagactgtggcctcccactatgagtcaccacctctgattcctgaggtcccctccagtcattggctctctcccaagccagccagctgatcagccttgaggacagcagagtgtctgccaagagagatctgtgaagtttcccatcaccgtggcagtccacaatgtgaagcccctgaggccacccttctccatgtgtcccccacactgtccctgaccctcccaccatcctagaaaaccagcctcccaggtcctctgtcatggaagtaatttacagcaaggcagaaagagctgaaagatttataaatgtgtaaaattta

SEQ ID NO: 29468 - DNA, 437 bp, Homo sapiens
ttattacctgagaccctgaaaggaagcactaaagaaatgaagacagaggaataccaggagagaaaggaggtccagttagacctaaaggtgggcaagaagaagaagaagaggagtttggatgcttcatctctgctgagacccagtgcctggcactgaaggtgctcaggaaataccttctgaatgatcggaagcccctgccatctgctaaactggatctatgatgacagaagccgaggaatgtgaggttcatctagagagttcttgtgaattttccaagggaggcacctgttgaattcaggcatcggcatgtgacttgatttggtcaatgaaatgtgagagaagtgacatccactttgaggcaggcactttccgagttgccccgacggccactctccatactgctgccagaagaaccttgaaatatcgctctttttaat

SEQ ID NO: 29469 - DNA, 257 bp, Homo sapiens
  misc_feature (80)..(80): n is a, c, g, or t
gcctagtcttcctgaggtagctcctgtcagcccactgatcccaccacccgctccctactgccccgcggtcttcgcgtgantcggagactgagggacaacaaaaatggcggaggggagccagtcggcgcctgaggcaggcaatgatatgggaaatgatgatgccattggagggaatgtgagcaaatatatagtgcttccaactggctattgtggacagcccaagaaaggacatcttatctttgatgcttgctttgaaa

SEQ ID NO: 29470 - DNA, 477 bp, Homo sapiens
gtcatctttctcaatattttctcagagctctagaatttaagagtattcctctagtgctagtagtacattccttcatatttcttgaagtgcctttgaacttaaatggtattaacattctagcaatttcaagggatctattatcatcatggtgggagacatttcctcccatgtttttgaaaaatgggaaattaagaacccaaaacattaaaatttaattagaaggtaaatttgctacagcagtacatagaaatttagcctcatgccttctgttacatggctaaatccctaccatgccacagtgatgccttacccctaagtgtttaatgtaatcacctcaattcctgacttactaagatctttaaaagcacttctttacagtttcatttaacacaatgtatttttatttgtgtaaataacaaaactccattaagaaaatcctccttttgtgtgtgtgtgtgtgtgtgtgagtgtgtgtgt

SEQ ID NO: 29471 - DNA, 492 bp, Homo sapiens
ttggctgtccaggtctccagtttcttattgggcatgaagatgtgtgcacagtggagtggacaggatacaggctaacacagaggtcaaggctctgctcccactttctccctaaatggctctgtgacgtcatttctctgtgcttcagttttctcttctgtaaaaaccagttagttagatcagtttgtctctgaacttcctgcaaactaagaatcactaacgtggatgtataattctgttttcctttttttaactcaggaactcacatgactttatgtaaatcacattttcctccaccattattaagtctctgtagatatatcgaccataaatctttgtgaaaagatatctaaagctggtcttcaggcgttttcagaaaattctacacagattgtgcctggaaatttgaaggctgcctttagaattcagctgacattcatgagtccttaagaattaggataacatgaggccaggtgcagtggctcacacctgtaa

SEQ ID NO: 29472 - DNA, 213 bp, Homo sapiens
gtttcgccatgttgcccaggctggcctccaactcctgacctcaactgatccacctgccttggcctccccaagtattagtattacaggtatgaaccaccatgctcggccatattcactattttgaatttcagttatttatgttcctgagaaaaagaggcaagaagaaacaaaggatagatggtacagatagataacaaataacaagaccaaaag

SEQ ID NO: 29473 - DNA, 427 bp, Homo sapiens
cagactagaaggtaccagaaaccagccaggagggaccgaatgcaatggtccttcagagaacagatacagtttctgaccaatgagctatatcccttgacagtgaagtgaattatgcctttcgtggattccaaagtcccacatttctctgaagtgggtttcatgtgccacaaaaagacattggtggcctgtataggaaaggaagtggctcttcaagcaccatatgtggtgagttgagggcagagctgtggagagcgctgggtcagagggttgtacaaagagtgaatcaacctggaagcatgtgatggggatcatgaggactcaggaaacaagactcctggactacagccaagaagaagttagaagtaaagcctatgcggtggctgacacctgtaatcccagcactttgggaggccaaggagagagcatc

SEQ ID NO: 29474 - DNA, 384 bp, Homo sapiens
ggagaatgactgaaataaagaggaatctgagtcatgatgaattgaatcgacagttactggggcttgagtcttcactgtctgtcttcgagtctagtgctgggtcccaaagttagggatgataggagtggaaagctgaagttatgggacaggtttaacacaggaccagactgagggctctattttaaaatgtctgatgctgtctttgttgatgactgttggtgactgtcaatgataatgactgttggtaattatcgagataattcaatgtactcatctcagcccttaactgtcttttttaagtatgaagcctttctccctcctgaaacatacaatttttctaaaactgtgtggtgaattcacaaggctaagggttaatccctgcct

SEQ ID NO: 29475 - DNA, 589 bp, Homo sapiens
ctaacgtcctgcattatgaaactttttttttaaatgcagctattttttccttcatctatgttcaatttctttgaagataaaaatttcaagtgcagtgaaactattttcatctttttcgatattacagtctccccatgtatggaattcattttgcatggcctcagaccaaatatttccaagtcccgtccttatatatagcaaagccatgtattttgctcatgccttcaagcctgggagtaacacagttttgctgtcagaagaagatggttgctgaggcaagtgggaacaggcatcccgcaccatgccatcccacctgcccttcccgactggagctgaggccacagggtttttcaccgccaaattgatatgcttttgaaggaagcatctggttctttggcagctccataggagtaatcttggtggttggagagtttctcctgcatctatcacatagtctagttattgaaagggttcctggcattttcacgtcccagtttctgggcataggaatgtgaaaaagctgaagtctgtttgcacttgcaaagcctctttgaaatttgtcaggctaaaaaaaaattctctgtgttta

SEQ ID NO: 29476 - DNA, 392 bp, Homo sapiens
acaccagtgattaaaacaaaaccctgtacattgaacacacagaaccacaaataataacgatggcaggtatcttttgttaagtaacttatgctcaatactatatggtcagttgaaattgtaggctgggtgtggtggctcatgcctgtaatcccagcactttgggaggccaaggcgggtggatcacctgaggtcgggagttcaagaccagcccgaccaacacagagaaaccctgtctctactaaaaatacaaaattagccaggcgtggtggcgcatgcctgtaatcccagctactagggaggctgaggcaggagaatcacttgaacctgggaggcggaggttaggttgcagtgagctgagatcacaccattgcactccagcctgggcaacaaga

SEQ ID NO: 29477 - DNA, 2447 bp, Homo sapiens
agacgaccaaccacttatgtgctaggtacgaggctgggtggtggcgagtccaaaatggcggctctcaggctggcgcgctccgtgctgctggggctttgaggtggtcgccgggggtccgggggaccctttccccgccgcggaagccctagaggatgaatcggggaccctgctaaggtctggcggcggggctggagagcagtggcagcaagggctgcggtggcgtccacgcagcgggatgtgcgagagttactccaggtcgttgttgagggtctcggtggcgcagatctgccaggcgctgggctgggactcggtgcagctcagcgcctgccacctcctcacggacgtgctgcagcgctatctgcagcagctgggccggggctgccatcggtactctgagctctatggccgaacagacccaattttggatgatgttggtgaagctttccagctgatgggggttagtctacatgaactagaagactatattcacaacattgagcctgtcaccttcccacaccaaattccgtcatttcctgttagcaagaacaatgtacttcagtttcctcaacctggaagtaaagatgcagaggaaagaaaagaatacattcctgattacctgccacccattgtgtcttctcaagaagaagaagaagaagagcaggtgcccactgatggaggcacatcagcagaagccatgcaggttcccttggaagaagatgatgaattggaggaggaagaaattattaatgatgagaatttcctgggcaagagaccactggatagtcctgaagctgaagaactgccagccatgaagcggcctcggctattaagcactaaaggggacacgctagatgttgtgttattggaagctcgagagccactcagctcaataaatactcaaaagatcccaccaatgctttctccagtccatgtacaggacagtacagacttggcacctccctcacccgagccgccaatgttggctccagttgcaaaatcacaaatgccaactgcaaaaccattagaaacaaagtcatttacacctaaaacaaagactaaaactagctctccaggacagaagactaaatcacctaaaaccgcccagtcaccagcaatggtcggaagtcctattcgatcaccaaaaactgtatccaaagaaaagaaatcacctggacgttccaagagccccaagagtcccaagagccccaaggtcacgactcacattccccaaacacctgtgagacctgaaacgcccaacaggactccttcagctacactcagtgaaaaaatcagtaaagagactatccaggtaaaacaaatacagacaccccctgatgctgggaaactgaacagtgagaatcagccgaaaaaggctgtggtagcagataaaacgattgaggcctctatcgatgctgtgattgcacgagcctgtgctgagcgagagccagatcctttcgaattttcttctggatcggaatctgaaggagacatttttactagccctaagagaatttcaggcccggagtgtactactcccaaagcttccacttccgcgaacaatttcacaaagtcaggatccactcctctgcctctttccggtggaacctcaagttccgataactcatggacaatggatgcctccattgatgaggttgtacgtaaagcaaaactgggaacaccttcaaatatgccccccaactttccttatatctcttctccgtcagtgtctcctcccactcccgaacctctccacaaggtgtatgaggagaaaaccaagctgccttcctccgtggaggtaaagaagaagttgaaaaaggaactaaagactaaaatgaaaaagaaagaaaagcagagagatagggagagggaaaaagacaagaacaaggacaaaagtaaggagaaggataaagtgaaagagaaagagaaagacaaggaaactggcagggaaacaaagtatccctggaaggaatttcttaaagaggaagaggcagatccctacaagtttaaaatcaaagaatttgaagatgttgatcccaaagtgaaattgaaagatggacttgtgaggaaggagaaagagaagcataaagataagaagaaagatagagagaaaggcaagaaagataaagataagagagagaaagaaaaagtgaaagataaaggcagagaagataagatgaaagccccagcacccccactggtgttgcccccaaaagagttggccctgcccttgttcagccctgccacagcctccagggtcccagccatgctgccatctttgttgccagtgcttccggaaaaactgtttgaggagaaagagaaggtgaaggagaaagaaaagaaaaaggacaaaaaggagaagaagaaaaagaaggaaaaagagaaggagaagaaggagaaggaaagagagaaagagaagagagagcgagagaagagagaaaaagagaagg

SEQ ID NO: 29478 - DNA, 1996 bp, Homo sapiens
agacgaccaaccacttatgtgctaggtacgaggctgggtggtggcgagtccaaaatggcggctctcaggctggcgcgctccgtgctgctggggctttgaggtggtcgccgggggtccgggggaccctttccccgccgcggaagccctagaggatgaatcggggaccctgctaaggtctggcggcggggctggagagcagtggcagcaagggctgcggtggcgtccacgcagcgggatgtgcgagagttactccaggtcgttgttgagggtctcggtggcgcagatctgccaggcgctgggctgggactcggtgcagctcagcgcctgccacctcctcacggacgtgctgcagcgctatctgcagcagctgggccggggctgccatcggtactctgagctctatggccgaacagacccaattttggatgatgttggtgaagctttccagctgatgggggttagtctacatgaactagaagactatattcacaacattgagcctgtcaccttcccacaccaaattccgtcatttcctgttagcaagaacaatgtacttcagtttcctcaacctggaagtaaagatgcagaggaaagaaaagaatacattcctgattacctgccacccattgtgtcttctcaagaagaagaagaagaagagcaggtgcccactgatggaggcacatcagcagaagccatgcaggttcccttggaagaagatgatgaattggaggaggaagaaattattaatgatgagaatttcctgggcaagagaccactggatagtcctgaagctgaagaactgccagccatgaagcggcctcggctattaagcactaaaggggacacgctagatgttgtgttattggaagctcgagagccactcagctcaataaatactcaaaagatcccaccaatgctttctccagtccatgtacaggacagtacagacttggcacctccctcacccgagccgccaatgttggctccagttgcaaaatcacaaatgccaactgcaaaaccattagaaacaaagtcatttacacctaaaacaaagactaaaactagctctccaggacagaagactaaatcacctaaaaccgcccagtcaccagcaatggtcggaagtcctattcgatcaccaaaaactgtatccaaagaaaagaaatcacctggacgttccaagagccccaagagtcccaagagccccaaggtcacgactcacattccccaaacacctgtgagacctgaaacgcccaacaggactccttcagctacactcagtgaaaaaatcagtaaagagactatccaggtaaaacaaatacagacaccccctgatgctgggaaactgaacagtgagaatcagccgaaaaaggctgtggtagcagataaaacgattgaggcctctatcgatgctgtgattgcacgagcctgtgctgagcgagagccagatcctttcgaattttcttctggatcggaatctgaaggagacatttttactagccctaagagaatttcaggcccggagtgtactactcccaaagcttccacttccgcgaacaatttcacaaagtcaggatccactcctctgcctctttccggtggaacctcaagttccgataactcatggacaatggatgcctccattgatgaggttgtacgtaaagcaaaactgggaacaccttcaaatatgccccccaactttccttatatctcttctccgtcagtgtctcctcccactcccgaacctctgcagcatcgactgtatagaatccgcccgctctccacccacccctcactgatactagaagagaagacccacaggcatgacccaagtctctcaaatacacactcacaaacacacactcctcgctacctgaatcatcaaaaataatcttattctctaatttcatttctttctcttctccttcctagaatacctctctttgtagtccctaaccaaaataagtcatggtggtgaggcgggatcctctagaca

SEQ ID NO: 29479 - DNA, 407 bp, Homo sapiens
agagattattttttctttatagctctcaatgaattttaaaaagttcacaccttcccctagctgtaagcattcttcacgtgaggcagcctatggaatgcatgtgtcatgcccaggcgatgttgtatgcagaagccacagaactttgaagtacagtggagtctgtagtatgtgcctggcacctaggaatccttgtatatttctttctggaaagctacagggagggttacagctttataaaaaggaatggtgcatcaagaaagcaatgcagtgctgggattacaggcctaaggcactgcacctggcccaaatattttttaatggaggtacaattcaacccataacagcctctgtgtgtgtgtgtatctgtgcttatgtgtctgagaactatggtgatgcttgtagttaaa

SEQ ID NO: 29480 - DNA, 163 bp, Homo sapiens
atccatccacccacccatccatccactcatccatccatccacttatccacccacccgtccatctgcttatccatccatccatccatccacccgtccattcatccatccactcacccatgcattcactcatctatccatccattcacccatctatccatccacc

SEQ ID NO: 29481 - DNA, 329 bp, Homo sapiens
ttgtcttgaccttcgttttgtaagtatcttgaagattcctttctcatccaaatctgttagaatcaccgcagtttccaaagttggctaaacatcagaatcacctgaggtgcttgttaaacacagggaatgtcctgatagcctctggagattctgattaagtggaccagttaccagaaagcagccccaatccaggccccatgagaggattcttggatcttgcgcaagacagaattcgaggcaagtccacagattaaagtgaaagcaagtttattaggaaattaaaggaataaaagaatgaccactccataggcagagcagccccagggctg

SEQ ID NO: 29482 - DNA, 507 bp, Homo sapiens
agagcatcctggtttgaaagaacaaaaggatctaaggcagtagccctgggaatgtacttcaaaagttcaggatcaatgagtatccagtttagctaaagaaaacaattctagtgaaagaagtaaacaaacgtttggtaggatgaaatggttccatcttatggagaagcttaaatattgatccaagaattttgaacaccctagtggacttcaggagaaccttgtgactctgagcaaagataaaaataaattgatatgggaaatgatgttcctttcagattagagaaactcctgaattaatctcaaatttggaggccgcttagtataacaaaaaagtatattttcaatattgctgatatgtaatctaagaatggttctctcttcctgtcactgaaattcatctattatttattccaagctttaaaaaaaaagtactaaaataaaattgtgtgattgagcattgcaaaagagtgggtttttataatgtggaagccaaaattttttatcaga

SEQ ID NO: 29483 - DNA, 991 bp, Homo sapiens
acagcaaaggtggtttgaggtagtcacctgcttacagataacagccaaagatagaattccaagttataaagcataaaaaagagccaacagaagtaactaatccgggaaaagtgaacatatgggccctttaaagactacaagatttgctagataaactggaaatggagaagttattgcagacagtcatgaaccacaaatcactgtgattaaaattttcttctgatcgtaatccacgaatgcattcattttttggacattgcttacttatcttttaaatgtttcttttattacaaagcctattttgagtagcttttaaaactgaatttcctttaattggtttgaagcctagagatgaatttcgttttcaaatatctggtgggatggtaatggggattagagaactgacatgagaaaagaggagctgttttggtattaaacgaataaaatcttaagcaaatataggtgtcttttattcttaaaaaatagcagatacagtttatccacatttgtaaatatttgtataaagaaagtagcaaaacagttttggtttaaaaagttccaagtctcattgcaatcattctttgtaaaggctgacttgtaatgaatatgtattaagcaatatttattgactatacaccatcttgttctagaagagtttaaagccacttaagaagataaataagatataaaaagaaaacagcagtcaaaagcagatgagaagaaatgggaaaaacaaaaaaaaaagaaaataatgaggctaatataatgctgtgtgtacatgaacatgaatgtgcctgtgttacacattttcaggccacaaatgtttctttgtgcccctgcatgcacaagggtatttccaggtcatttatcattgtgaacagtgttgcttatgataaaaaatagattctataaactctaaatatactttttttctaccactctgtgtaaaagatcatgaacgtaaataaattttagatatgaaaagggttag

SEQ ID NO: 29484 - DNA, 521 bp, Homo sapiens
ctccatattaaacctgttctttttttttttttgagacggagtcttgctcttatcccccaggtggagtgcaatggcgcgacctcggctcactgcaacctctgccttccgggtttaagcgattgtcctgcctcagcctcctgagtagctgggattacaggtgcctgccaccatgcccggctaatttttgtatttttagtagagacggggtttcaccatgttggccaggctggtctcgaactcctgacctcaggtgatctgcccgcctcggcctcccaaagtgctgggattacaagtatgagccaccgtgcctggcctaaaactgttcttatgctgactctatcacttattgaatcaaagttggcattaatttcactttatagtttaattaactataaacactaacattttaaaaattaagcaactttgtctaaattggagtctttgtcattaatgtgtatttagacactggtaaatgtttttaagtctgcttctgttgtctataaacatgacttttgatctac

SEQ ID NO: 29485 - DNA, 438 bp, Homo sapiens
gtaaaccacgagcatgatacaacactcataaaactggcatttgggaaagccaccacagtaaagctatttataaacaaggaaattatacagagttctttgccactgaatgtacaacacagaaacaaagccaaaaggccctaccaacatacatcgggccaggcacagtggcttgtgcctgtaatttcagcactttgggaggctaaagcaggtagattacttgggctcagaagtttgaggccagactggaaaacatgacaaaaccccatctctactaaaaagacaaaaaaaatgctgggcatggtgacgtgtgcttgtagttccaactacttgagaggctgagataggaggattgcttgagcctggggaagtcaaggctgcagtgagccaagatcatgccactgtattcctgcctgagcaaaagagtgggatcctgtctca

SEQ ID NO: 29486 - DNA, 273 bp, Homo sapiens
aaattttctaatatccaaacagattttgaaattccatcatgattttggtgtgaatttttcttatcatctcttgggagaaaacgtccaggattctgttggtggcagaatccatgtcaaagagttaaggtatgagggagggaatgcccaccccatctggcctggaataccttctagatgcttttatccagtgtggcaacagagcagcaacactggcatcaccaggcatgcagaatctcgggccgtatcccaggcctcctaagtcatatctgaatt

SEQ ID NO: 29487 - DNA, 626 bp, Homo sapiens
ttggccaggctggtctggaactcctgacctcgtgatccacccacctcggcctcccaaagtaccaggattacaggcgtgacacgcgcgcccggccttcacttttatataatttatatgactcgagagttttgcccatgatcccaccaccccagcacatcagtgttgaaacgcttccagggagttcggtgccctgaccacagcctctccttctctagccctctctatccccacttccctgttctttgggccttcatcagggactctcatctgttccccagtccattcctccctgggttcagcactttacctttcctacgcataattaatgatttgtcttcactcatgactcatcaaatatttgagtgtcagctggggataccatgaggcagacaaggcctcttgtctttttggagcttgcattcaatgcgtagagacgccaacaacatcatcacataggctggtaagatagtaaggccattattatgtgtcaacagtgactcatgcctgtaatccccgtgctttgggaggctgaggcaggaggatcatttgggcctggaagtttgaggcttcggtgagttataacagccccattgcactccagcctaggtgacagagcaagaccctgc

SEQ ID NO: 29488 - DNA, 336 bp, Homo sapiens
atgaaagaaacaatcatgaaccaaaaactcaccaaacggcaagcagaagtgcacactggtcggaaaggaactgctcacaggaaaaaggtggttcacacgacagcagaggataaaaaatttcagttctccttaaagaaattaggggtaaacaatatccctggtattgaagaggtgaatatgtttacacaccaaggaacagtgattcactttaacaaccctgaagttcaggcatcgctggcagcaaacactttcaccatgacaggccatgctgagacaaagcagctgacagaaatgctactcagcatcgatcataaaccagtgctgcagatggtctga

SEQ ID NO: 29489 - DNA, 443 bp, Homo sapiens
ttaatttgtctaagggcatgcaagtataaagtttgtgtttgattccacgtactcaagaggcacagtttgtgctgttactcttatgcttcgttacctacctgcttgctactattatctccatatttagctaaagaaatagaagctcagaaaagttaaagtaacttgttggaacattagtttttagcaaaccaataaatatctgttattgaactgaaatgagaggcacagctaatacatgctagacccaggattcgaacaatggctatctgtcctgaaagcttatccttttctcactactctgtactgaggataacaaaagggcattttttaggaagaaggaggcagtattaatttttagttacacaagtgatatataagtacagtctgcttttttaaaaagtggcacaaatcagataacactaaagacccctttgacgctatgc

SEQ ID NO: 29490 - DNA, 1161 bp, Homo sapiens
gccatgccgcttcatactattgcaatggtattagatttcaacatatgaagttgtgaaggggacatacattcagaccatagcactaagtattttattttactgaatactaccataaatggaattattttctgaatttccttttggattgttcattgttggagtattttttttaaaaaaacctaattgttgtgtgttgattttgtactctgcaactatgccaaaactatttgttagctcatagatgttttgtggattatatgctaaataatgttatctgcaaatagagtagttttacttctgcctttcaatttgaatgtcttttattttttttttcttgcctatttgctctggctagaacttttaatacagtgttgaattgcagtggtgtgaaagcactatcattgcctgttcatgatcttagggggggatctttcagtctttcactatggagtatgttacctatgagttttttgtatatgtgctttattatgtggaggaacaggcagcagtctttgctgtttggcagcctccactggtgataccgaggcaaacagggtctggagtggacctccagcaaactccagcagacctgcagcagaggggcctgactattagaaggaaaactaacaaagagaaaggaataacatcaacatcaacaaaaaggacatccattcagaaaccccatctgaaggtcaccaacatcaaacaccaaaggtaaataaatccacgaagatggggagaaaccagcacaaaaggctgaaaattccaaaaaccagtacacctcttctcctccaacacactcctccacacaactccttgcctgcaagggaacaaaactggacagagaatgagtttgacaaattgtcagaagtaggcttcagaaggtgggtaataataactaactcctccaagttaaaggagcatgttctatccaatgcagggaagctaagaatcttgataaaaggatagacaaattgctaactagaataaccaggttagagaagaacataaatcacctgatggagctgaaaaacacagcacaagaacttcgtgaagcatacataagtatcaatagctgaatcaatcaagtggaagaaaggacataagagattgaagatcaaattaatgaaataaagtgagaaaacaagattagagaaaaaa

SEQ ID NO: 29491 - DNA, 456 bp, Homo sapiens
tcaagcgatcttcctgccccatcctcctagagcactgggattacaggtatgagccaccacacccagtcccaagcctcatgttttcaccaacacactcctccacacaactccttgcctgcaagggaacaaaactggacagagaatgagtttgacaaattgtcagaagtaggcttcagaaggtgggtaataataactaactcctccaagttaaaggagcatgttctatccaatgcagggaagctaagaatcttgataaaaggatagacaaattgctaactagaataaccaggttagagaagaacataaatcacctgatggagctgaaaaacacagcacaagaacttcgtgaagcatacataagtatcaatagctgaatcaatcaagtggaagaaaggacataagagattgaagatcaaattaatgaaataaagtgagaaaacaagattagagaaaaaa

SEQ ID NO: 29492 - DNA, 301 bp, Homo sapiens
tgttcatgggctcatatctcaacagttactggatatttattgaattttatatgcaacacagacacggcatttatctttaagatattttttgcctctcatgttttagctccaagacatctaagtcactttggtagaaagaagccagggcaggcagtgcccacacctcctactcgaggcttcatttctgaactagagcagttacagagaacatcacaggaccctgagtagggcagccagggtaaaataataaaactgaacacagtaacatcttctattattatattatattatattatattat

SEQ ID NO: 29493 - DNA, 178 bp, Homo sapiens
ggcccaatgaatccttaagctctcatttgttcctagcaaaactgtgcctttgggaaagtcgtttggcagaaaataatctagcttgctttgctattctgaaattggtttcaggaaattaaaagcgaaggtctgaattatatccccagaactgtaacatttaagactgaattctacttca

SEQ ID NO: 29494 - DNA, 494 bp, Homo sapiens
ttttttgtaattactttttgtgttgaactcttacagactcacaggaaattgcatggtacatacagtcccacgtaacattcatccagtattcccacagtgggaacatcttacataaccatagtataatatcaaaaccaggaaagtgacatgggtacattactgttaactagattacagaggaccttattcagtattcaccagtttcacatgcattcctgtgtgtgtgtgcacgcatgtgcatgtgtgtttctatgcaatctgatccatataaatatttgtatacctaccgccacaatcaagatagagacccacaaaggaatccccttgtgttaccactatagtggcaggcacacacacatatacatgcacatacacaaacacactgtatctgtccctttgcaaataccaatctgttctccatctctgttgtgttctcattgtaagaatgttatataggctgggcgctgtggctcatacgtgtaatcacagcactt

SEQ ID NO: 29495 - DNA, 223 bp, Homo sapiens
tcttctctgttttccttcagtgctttcacggtttcatgtcttaactttaaaagtctttaatccatgttccattgattttcctatatggtatgagttaagagtccagtgctagtcgtctgcccgtgggtatcaagttcttccaacacagtttcttaaagagactgtgcttttctcattttatggtcttgacatctgtcaaaaatcactccatcacaaatgcatg

SEQ ID NO: 29496 - DNA, 340 bp, Homo sapiens
ctagaaagcatatttactctcaaatctttaattattaccagagcaataattttcaaactttttaaaagctgaaacctcctttgcttcccaccaaaataaacttaacaagggaccgggtgcagtggttcacgcctgtaatcccagaacttttggaggctgaggcaggcagatcacgaggccaggagttcgagaccagtctggccaacatggtgaaaccccatctctactaaaaatacaaaagaaattagctgggcttggtggcacaagcctgtaatcccagctacttgggaggctgaggcaggagaatcactcgaacccgagaggcagaggttgcagtgag

SEQ ID NO: 29497 - DNA, 478 bp, Homo sapiens
cgggctcaagtgatcctcccacctcagccccctgagtagctgagactacaggaacatgccaccatgccgagtaattttaaaattttttgtagagacattatgctgcccaagctggtctcaaactcctggcctcaagcaattctcccgccttggcctcccaaggcactagaattacagatgtgagccactgcaccctgcccagatgaacacttgctttgctcaccactgtgtctctatgtagcatcagagcatcgtcctggtacaaagagtggggcctgaataaagatttactggttaatggatggataggtcaaatgggtattcattcttttgttcctgagcacaacaggtgtaataggtcctgtgccaggtggcacggggaggcagagattagtcaaatgggggccaggtgcggtggctcacacctataatcccagcactttgggaggccgaggcgggcagatcacctgagtgcttc

SEQ ID NO: 29498 - DNA, 537 bp, Homo sapiens
ataagggagtatagcaagagaaagacaaaggatttaggaacacagggaaaccaataaaaacatctgaagatcgtggtgaacggaaaagtcccaggtagtagctatatgtcaaacttacagaacaactaacttggggtaggaggaggagaactgaagacttcagatgaaattccccaagataaatatgcaacagatagaacacttacacatgttcaaaagctatttttacttacattagagaaccatggtatgaattagtaataaaagcacacaaaaccaagcaaataaaaaaatggatttattaactagtggaaacagttatacaagagaagaaatagaatcatgatatactctgtgacttagctataaataatacttatataatcaaaatcatattagccctagatactgatttaaccaaaaattatgatataaatatatcagaaggataggaggaagggaaatgtatgcaagaatgcaagaagaggaggtataggaaagtaaatcctcatcttccatagaaggaagtcaatggac

SEQ ID NO: 29499 - DNA, 6238 bp, Homo sapiens
gcagacacgcgtggcgcgggccgccgtttccgcaaacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttacgtgaactgttgtccttgctttacaccaccatttggaaaacttaccagtttttagatgtagatgtagtgaaaaacttcaagaatgaagcagagcaattgagtattcttttttaaattattaagccatgatttacaaaaacattactttctgtaattcacaatacttgttttaaaaacatagtgtcttcattagtgtgcatctattaactgttcatggtgttagagttgcaaactttttagcaagaaaatatggatttcctcatttcagttccttctgcagcctgtgaatctccacaaagtgttaccagtttacaaaaataagtctttttgccttaagtcattttggaaataagtaatactgcatctgactctggtggctgtattagctaggaaaggtttgtaaatggtgtcagtgaggtggggaaaggaagtcttcctgtcacatatgcaggttcgttttcattctagggcagtgccaggaagtatattgatagctttgtaggtacaggaaaaacatcatcattatttcctctgttcacatttactggtcttaattaacaggtaataataatacatgtacttttagcctgaaacctcttccacgccatgggtaacttgggggagagaagaatcctccaaacgatggagtagccagtggtaatacaaagcagggagaacagaaaggtagagttactaaggccttcagtgaacagaaaggagcagagagcaagattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactagaaaaggcttcccctgcctatcctctccgatcaccaaggtggaagggagctagtaggactcttccttgacacaccttgtagtctaaatgttcggtattctattcaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccattattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagacctccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctga

SEQ ID NO: 29500 - DNA, 4176 bp, Homo sapiens
tttgtccctcggccgccgtggaggggtggaactggcactcccacccctgacatgggctcacttcgcattagccctgtgcttcactacccaacgcgatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccattattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagacctccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctga

SEQ ID NO: 29501 - DNA, 6109 bp, Homo sapiens
gcagacacgcgtggcgcgggccgccgtttccgcaaacagaatcgcgtttggctgtgctgtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttacgtgaactgttgtccttgctttacaccaccatttggaaaacttaccagtttttagatgtagatgtagtgaaaaacttcaagaatgaagcagagcaattgagtattcttttttaaattattaagccatgatttacaaaaacattactttctgtaattcacaatacttgttttaaaaacatagtgtcttcattagtgtgcatctattaactgttcatggtgttagagttgcaaactttttagcaagaaaatatggatttcctcatttcagttccttctgcagcctgtgaatctccacaaagtgttaccagtttacaaaaataagtctttttgccttaagtcattttggaaataagtaatactgcatctgactctggtggctgtattagctaggaaaggtttgtaaatggtgtcagtgaggtggggaaaggaagtcttcctgtcacatatgcaggttcgttttcattctagggcagtgccaggaagtatattgatagctttgtaggtacaggaaaaacatcatcattatttcctctgttcacatttactggtcttaattaacaggtaataataatacatgtacttttagcctgaaacctcttccacgccatgggtaacttgggggagagaagaatcctccaaacgatggagtagccagtggtaatacaaagcagggagaacagaaaggtagagttactaaggccttcagtgaacagaaaggagcagagagcaagattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactagaaaaggcttcccctgcctatcctctccgatcaccaaggtggaagggagctagtaggactcttccttgacacaccttgtagtctaaatgttcggtattctattcaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccattattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagacctccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctga

SEQ ID NO: 29502 - DNA, 4408 bp, Homo sapiens
gcagacacgcgtggcgcgggccgccgtttccgcaaacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccattattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagacctccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctga

SEQ ID NO: 29503 - DNA, 5650 bp, Homo sapiens
gcagacacgcgtggcgcgggccgccgtttccgcaaacagaatcgcgtttggctgtgctgaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttacgtgaactgttgtccttgctttacaccaccatttggaaaacttaccagtttttagatgtagatgtagtgaaaaacttcaagaatgaagcagagcaattgagtattcttttttaaattattaagccatgatttacaaaaacattactttctgtaattcacaatacttgttttaaaaacatagtgtcttcattagtgtgcatctattaactgttcatggtgttagagttgcaaactttttagcaagaaaatatggatttcctcatttcagttccttctgcagcctgtgaatctccacaaagtgttaccagtttacaaaaataagtctttttgccttaagtcattttggaaataagtaatactgcatctgactctggtggctgtattagctaggaaaggtttgtaaatggtgtcagtgaggtggggaaaggaagtcttcctgtcacatatgcaggttcgttttcattctagggcagtgccaggaagtatattgatagctttgtaggtacaggaaaaacatcatcattatttcctctgttcacatttactggtcttaattaacaggtaataataatacatgtacttttagcctgaaacctcttccacgccatgggtaacttgggggagagaagaatcctccaaacgatggagtagccagtggtaatacaaagcagggagaacagaaaggtagagttactaaggccttcagtgaacagaaaggagcagagagcaagattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactagaaaaggcttcccctgcctatcctctccgatcaccaaggtggaagggagctagtaggactcttccttgacacaccttgtagtctaaatgttcggtattctattcaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccattattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagacctccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctga

SEQ ID NO: 29504 - DNA, 4647 bp, Homo sapiens
cgtgacgcgtgggtcgacccacgcgatcgtaggtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttacgtgaactgttgtccttgctttacaccaccatttggaaaacttaccagtttttagatgtagatgtagtgaaaaacttcaagaatgaagcagagcaattgagtattcttttttaaattattaagccatgatttacaaaaacattactttctgtaattcacaatacttgttttaaaaacatagtgtcttcattagtgtgcatctattaactgttcatggtgttagagttgcaaactttttagcaagaaaatatggatttcctcatttcagttccttctgcagcctgtgaatctccacaaagtgttaccagtttacaaaaataagtctttttgccttaagtcattttggaaataagtaatactgcatctgactctggtggctgtattagctaggaaaggtttgtaaatggtgtcagtgaggtggggaaaggaagtcttcctgtcacatatgcaggttcgttttcattctagggcagtgccaggaagtatattgatagctttgtaggtacaggaaaaacatcatcattatttcctctgttcacatttactggtcttaattaacaggtaataataatacatgtacttttagcctgaaacctcttccacgccatgggtaacttgggggagagaagaatcctccaaacgatggagtagccagtggtaatacaaagcagggagaacagaaaggtagagttactaaggccttcagtgaacagaaaggagcagagagcaagattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactagaaaaggcttcccctgcctatcctctccgatcaccaaggtggaagggagctagtaggactcttccttgacacaccttgtagtctaaatgttcggtattctattcaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccattattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagacctccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctga

SEQ ID NO: 29505 - DNA, 4564 bp, Homo sapiens
gcagacacgcgtggcgcgggccgccgtttccgcaaacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttacgtgaactgttgtccttgctttacaccaccatttggaaaacttaccagtttttagatgtagatgtagtgaaaaacttcaagaatgaagcagagcaattgagtattcttttttaaattattaagccatgatttacaaaaacattactttctgtaattcacaatacttgttttaaaaacatagtgtcttcattagtgtgcatctattaactgttcatggtgttagagttgcaaactttttagcaagaaaatatggatttcctcatttcagttccttctgcagcctgtgaatctccacaaagtgttaccagtttacaaaaataagtctttttgccttaagtcattttggaaataagtaatactgcatctgactctggtggctgtattagctaggaaaggtttgtaaatggtgtcagtgaggtggggaaaggaagtcttcctgtcacatatgcaggttcgttttcattctagggcagtgccaggaagtatattgatagctttgtaggtacaggaaaaacatcatcattatttcctctgttcacatttactggtcttaattaacaggtaataataatacatgtacttttagcctgaaacctcttccacgccatgggtaacttgggggagagaagaatcctccaaacgatggagtagccagtggtaatacaaagcagggagaacagaaaggtagagttactaaggccttcagtgaacagaaaggagcagagagcaagattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactagaaaaggcttcccctgcctatcctctccgatcaccaaggtggaagggagctagtaggactcttccttgacacaccttgtagtctaaatgttcggtattctattcaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctga

SEQ ID NO: 29506 - DNA, 1958 bp, Homo sapiens
gcagacacgcgtggcgcgggccgccgtttccgcaaacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaa

SEQ ID NO: 29507 - DNA, 422 bp, Homo sapiens
acagattgttttatttattgtaatcatatgagaaactgaactcttatttatttcttctttaggtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgtt

SEQ ID NO: 29508 - DNA, 4141 bp, Homo sapiens
gcagacacgcgtggcgcgggccgccgtttccgcaaacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccattattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagacctccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctga

SEQ ID NO: 29509 - DNA, 6183 bp, Homo sapiens
gcagacacgcgtggcgcgggccgccgtttccgcaaacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttacgtgaactgttgtccttgctttacaccaccatttggaaaacttaccagtttttagatgtagatgtagtgaaaaacttcaagaatgaagcagagcaattgagtattcttttttaaattattaagccatgatttacaaaaacattactttctgtaattcacaatacttgttttaaaaacatagtgtcttcattagtgtgcatctattaactgttcatggtgttagagttgcaaactttttagcaagaaaatatggatttcctcatttcagttccttctgcagcctgtgaatctccacaaagtgttaccagtttacaaaaataagtctttttgccttaagtcattttggaaataagtaatactgcatctgactctggtggctgtattagctaggaaaggtttgtaaatggtgtcagtgaggtggggaaaggaagtcttcctgtcacatatgcaggttcgttttcattctagggcagtgccaggaagtatattgatagctttgtaggtacaggaaaaacatcatcattatttcctctgttcacatttactggtcttaattaacaggtaataataatacatgtacttttagcctgaaacctcttccacgccatgggtaacttgggggagagaagaatcctccaaacgatggagtagccagtggtaatacaaagcagggagaacagaaaggtagagttactaaggccttcagtgaacagaaaggagcagagagcaagattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactaggactcttccttgacacaccttgtagtctaaatgttcggtattctattcaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccattattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagacctccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctga

SEQ ID NO: 29510 - DNA, 5822 bp, Homo sapiens
  misc_feature (5771)..(5771): n is a, c, g, or t
  misc_feature (5804)..(5804): n is a, c, g, or t
  misc_feature (5807)..(5807): n is a, c, g, or t
gcagacacgcgtggcgcgggccgccgtttccgcaaacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttacgtgaactgttgtccttgctttacaccaccatttggaaaacttaccagtttttagatgtagatgtagtgaaaaacttcaagaatgaagcagagcaattgagtattcttttttaaattattaagccatgatttacaaaaacattactttctgtaattcacaatacttgttttaaaaacatagtgtcttcattagtgtgcatctattaactgttcatggtgttagagttgcaaactttttagcaagaaaatatggatttcctcatttcagttccttctgcagcctgtgaatctccacaaagtgttaccagtttacaaaaataagtctttttgccttaagtcattttggaaataagtaatactgcatctgactctggtggctgtattagctaggaaaggtttgtaaatggtgtcagtgaggtggggaaaggaagtcttcctgtcacatatgcaggttcgttttcattctagggcagtgccaggaagtatattgatagctttgtaggtacaggaaaaacatcatcattatttcctctgttcacatttactggtcttaattaacaggtaataataatacatgtacttttagcctgaaacctcttccacgccatgggtaacttgggggagagaagaatcctccaaacgatggagtagccagtggtaatacaaagcagggagaacagaaaggtagagttactaaggccttcagtgaacagaaaggagcagagagcaagattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactagaaaaggcttcccctgcctatcctctccgatcaccaaggtggaagggagctagtaggactcttccttgacacaccttgtagtctaaatgttcggtattctattcaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccattattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagacctccttctttagcagcccaacctgtagcaaatctagtttagcctggctatcctttccgatcaccaaggtggaanggaactagtaggactctttcttgaacaccttgnagnctaaaaggtcggatt

SEQ ID NO: 29511 - DNA, 1333 bp, Homo sapiens
aatcgagctcggtacctgtggaggtgcagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccattattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagacctccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctga

SEQ ID NO: 29512 - DNA, 1995 bp, Homo sapiens
gcagacacgcgtggcgcgggccgccgtttccgcaaacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaacccacctaacaaaaacaaaaaaacacaacaacaaaac

SEQ ID NO: 29513 - DNA, 347 bp, Homo sapiens
gagaactacttaattaatgctcttttgcatgacagactgaccctgtagatgctgaaaagacaccataagcagaagcagatggttctggaagagacagaacctacattgccattttcccagttatagtctacttcagaactggtttagataattggctgtgaaaagtttctgattccaagtaggccacaatattctggttaagagaaagctgatttgaatgacactttgctacttaaagctaaatggaggagccaaaaaaagtgtcatgggaaaaatacacctcttatataatatcctataatacacctattttatataatatatacctattatatatacacctatat

SEQ ID NO: 29514 - DNA, 430 bp, Homo sapiens
acagcagagatggggccaggagtagaatattcactggacagatcccaagtctgtagtagaaaacagcttgttcattatcctctgaatttcctttgccagaagagttgtagggaagaaatggggtggtcctcccattggtctaacttcttgagtgtaaggctttggttctcaactttggctatatgttgaagccactcttgattcctaagtctaatccccagggtttctgatttaattggtgtagggtgtggccaggaccaaataattgtaatgtgtagccaagattgagaaccactgccttaggagatgacaacccccagtctcagttaagaaattagcaggcttattttgcttaactctaggtaatatacgtactgagaaggtctgggaaccatcccaatagtaatgaggatccatagctccctgatct

SEQ ID NO: 29515 - DNA, 675 bp, Homo sapiens
ctaggagttaatgaagaatccatcagcagtctgtttgactttacccctgagtgcagaacaaccgatcaagaccaaaagattaagaaggcaaacgagtgtgcttcaaggctgatgtacggcatggagctagacgacatggatgaggtcgaattcttacggataaaatactgggacaggagacgccgggcggcaccgcattcttatagtgcacagcgtgggaggataaggtatggaccatggtacttcgagcctaagttggggaaaaagctaagaagtgatgaacctttgattgaccccaagcccgtacttgaaaagcctgatgaacccgacattcttgacggtctttatggaccaattgcctttaaggatttcattctaagcaagggctacagaatgcctggcgtcattgaaaagctgtttgccaagaagggatggacttacgactctgttaagactcctattcaacgtgcagtgcaagtttacaagtacaaagaagacgtcacagatgcatcaaaagaagattagatggttttcaatttactgcttaattgggtatttcttgctctcattctaaacatcaatcagaatttatgatgactggccccgtgaatgtacaactttggcaacatctgtaaattcaatacccaatgcttataaatatgtcttaatgacctg

SEQ ID NO: 29516 - DNA, 284 bp, Homo sapiens
atgattaacataaccattcttattttttcctatcctcaaaatggtactcctgccccctcttccacccccgtgtttcccaggatgtgctgagttttctttctactctggaacatgctgagagaaagagaaactaaatatatggagcagagaaaaaacttatctgaatattcttcaaaatactttccttgtagtccttcaaatttaaatttctaaaagtatttgctgttatgtaaaagatgtaaacttattttgatccttttgcaaatattaagtattgtcttatc

SEQ ID NO: 29517 - DNA, 416 bp, Homo sapiens
tttaaacagcctggtgtttttacagtttttgcattattgctttcattcaaaagggaatttgaagaaataaatggcagcaagaagcgaattgaatactgctgggaggttgtaaatgagcattcctcccggatggggaggggggcaaggagaagaaagagatgcctacaccaatcaatcctaccacacatccgacatcagccaatcccaccacacttggctaaggttcagtgatacacgatgttaagtcgtagatgtcttttattagcacacttgacagaccaggaaatgatttttctctacaattcaagaaaactgctgtttaataaaaatttcaattgctgattcaaatagacactttaagcaaagtttactgtatgaaagcttgtgaggataagtggaaatgtattatactgcct

SEQ ID NO: 29518 - DNA, 491 bp, Homo sapiens
cagctccattataatcttatgagaccatcatatatgtggtccaacattgaccaaagtgtcattatgccacacaggactgtatacaattcagcagcattagttacattcatgatgttgtgcaacccttacctctatctagttcaataactttttatcaccccaaaaagaaaccccatacctgttactactgcctgtttttcaaaataacggtgtggctgggtgtggtggctcacacctgtgatcccagcactttgggaggccgaggtgggcagatcacctgaggtcaggagttcgagaccagcctggccagcatggtgaaaccccatctctactaaaaatacaaaaaatagctgggtgtggtggcaggcacttgtaatcccagctactcgggaggctgaggcaggagaatcacttaaacccaggaggcggagcttgcagtgagccgagatcacaccactgcactccagcctgggccacggagcgagactgtc

SEQ ID NO: 29519 - DNA, 414 bp, Homo sapiens
gtcttgaactcctgggttcaagcagtccacccacctcagcctcccaaagttctgggactgtaggcatgagccactgcagctggcttaccacacgattttgaatggtgggagatatataaattattccattgaacaaaaaagccatatttaatttagccaatccctttctacggtaaccatcctcacagaagaggctttgtgagcccaccttttctaaatgctccgtattaatgctgtcagttggacacaaaagtgtcagggagctgtactgggtagttcttgctaaatatactcaggatctccatgcccattgagatcaggaatagatccagtcacctgttaaaaaagtaaatagaaatcatcacctagatagaattgatccattgaagctaaaaaatcaagcccttcaagtta

SEQ ID NO: 29520 - DNA, 772 bp, Homo sapiens
aacaaagcattgcagctatccttccccaacctggcccataaatgccttcatcagcaccctcacctgttacgaactccccactctgtctctgttcctactgggtgacacccgtagagcatttactgcacactaggcatcctcaaatacattatctgatcctacaacagagcccagagctagcacagggaccaaggtctcagaggttccaaacagcatagctggggttagaatgcaggcgtgtctgttcaaaaattcaatgtgtttttctgcatttttctttcctatcctgcccgagaatacaaagcttagtgttatctcaagtctcttctcaaatctcaattttaaatgctctatttctgatatttatttcttcctgaattgtgtggtcttatcggtccataccagttagttctcacaattagtatttaaactacaagggcgttcccaaagtcccccgacctggggttttattccatttacacccatcttccgtgattagactctcacatccttgaagcagggactggctcttatgtttcgaggtggccaaacgtcggagtcaaacagatcagtgtccccagccatgtgacctaagacaaaacaactccctttctttttttgagatggagttttgctcttatggcccaggctggagtgcaatggtgtgatttcagttcactgcaatctctgcctctcgggttcaagtgattctcctgcctcagcttcccaagtagctgggattacaggcacacaccaccatggccagctaatt

SEQ ID NO: 29521 - DNA, 522 bp, Homo sapiens
gtatttgcacagaaaattacaatcatttaattagtttcttctcacaccagctcgaagatcttaaaataacagcactctccttccttagtaattttcttgcaaaagcagataatttcctgcaatgttgagctcgccttgactcacaccgagcacatttcttgcaagtcaccatgcctggcttatgttaagtttttgattgagcctgaggttttatctgcatcagaagtcactcttgtggctgccttgtgttgtacccacttgccggtcagtaagcacaattgcaacccccaaggaaatccacaggaggagaaacatgtgtggcattaggacaatcccgtgcctagaagggacacggtggcaaggctgcgtcgtgggagtcacctttccctgttctgttctcataacctctgaattctgccacttgtgacccaaggagggggtatctctctgagcccaggaaatccagatctgtcaattttgggaagtcagaaataggctggtctggtgctgcgccaagggtgg

SEQ ID NO: 29522 - DNA, 439 bp, Homo sapiens
cctcaagtacacacgtacctaactggaaaaggcagggaccctgatcaccccttgcaaagttctcagagacagacaacggtcctcagatcacacactgagaattgctgatctaagggggctctaatctgtgtacaactcgggaagcagaaagatatagctttactgaatttaggtgacaccggacaaagtttgagggtgacaggacagttctaacattgaggtgtaaattctggaagggaagaagccaaaagggggtaagtcccccaaatttatatataaactgtcccaaaccttggctatctgctaaaccatgcatgtgcagaggagattctagggtacgatgacaaagaaaaagctggaaagaaaagatttcagctgctgccatcactgaaaagagaatgcagttttaatctagccaagcaaaccactctctacaacc

SEQ ID NO: 29523 - DNA, 805 bp, Homo sapiens
tcctcagtggcccagggcaggtggatatgctctttgaggtgctccttcagcaggctgactcattgatggcgtttgcaaaaaggatgtggttttttccaattccactgaaggcaaatcctagcacaaatatgggtactagtatgccgtctgagacagaaccatgacattgttggccagatgcagtggctcatgcctgtaatcccagcactttggaaggccaaggcgggtggatcacgaggtcaggagatcaagcccatcctggccaacatggtgaaaccctgtctctacaaaaaatacaaaaattagctgggcgtggcagcgtgtgcctgtaatcccagttactcaggaggctgaggcaggagaaccacttgaacccaggaggtggaggttgcagtgagccgagaacacaccactgcactccagcctaggtgacagagggatactccttctcaaaaaaaaaaaaaaaaaaaaaaaaggaaaaagaaaagaaccgcaatattgttatattaaccatatgtttaggaaatgagattcgaaataaatgttatggctgactgctgtgtttctatgtcctaccatagcaatagaaacctttaatctctgagagaaattatttctgagtcttgccttaccatttttataggcctgaggattgacttctaaagtgcctagatgtggccgggcgtaatggcttacgcctgtaatcctagcactttggaaggccaaggcgggtggatcacttgaggtcaggagttcgagaccagcctggccaacatggtgaaaccctgtctctactaaaaataca

SEQ ID NO: 29524 - DNA, 2492 bp, Homo sapiens
  misc_feature (427)..(427): n is a, c, g, or t
gttttccctgctgaaaacccaacaccagacggaaatgccaagtgcccaccccagaccccaaaccctaaggttggaccccaactcggaaccaggagtggagcgtggaaggtggggacagtgctcagggcccagtccagttggcactgacagcttccagtgtccccgctccatttccactagttcccctgggacaagcggcccctcactgggtgtcattcctacccaatgagttgatggaaaagtgggattcgtgccccacccaccatcatgcaagaaaaacaagcaaaacgaaacccagactgtagtttgccatcagggcaaaccactttctcaacatttttttgtggggggatgaacagtaaaccttgtggggccactgtggaaacttaaccgtgggtctcaaaccttgatgagcctcatctgtaanatgggttcaagaaagtcatctccccagagacggcggaaacggtccacctagggaacagagtggggcatcttttcgcagccgagcccagaacccatcacctaaagagttctggatgattcgttttgattttttttttttttaaatcaccatcgctgtcgtcatcagagtctcgcctagggcctggcacagagtagacgctcagttagaagctgtctggccttttcaccttctcccgggtcagcacacacagatttgggagtatttacctgcacagaacgcaccttcaggaactgccaaccagaagcaaaatccaaagctgctctctgcgatcccttcacttttaactctcagtctgcactttttttttttaactgagcatctattatgtgctaggcactgttccagtgctcggggacgcagctgtgaatgaacagaaacgggggatggaggacaggggagaaacccccttcacgggccttagatggcagggggtagggaaggagagacagaaaataaacagaaatatctgtccccagctgccagaggaggaggaaatgggcttggtgatggtgacattaagttctttgaaagctgggtttgttggcctctgaactctggcctttgtgggatctgttcttttggaaaagatgggagcccctgtgttcctagatcccagcctggccgggtggagtagggtggggaggtggtgtccacctgtgtggccccgttctcactccctaacgcccgtcccttctcccccaggtgaggggccttcccatcccaggagggttttctgcttccaaccgatccaggacttacccataaattccaaccgttctttggacaccagccctttcctcccctcttctccccttgccctgcccctctactggaggccacctggagtggcgaggggcctttggggtctgtcctggggcaggggcgggggtgggggaggctcctgaatcgtgggcagaagtgttcacacgccccccctgctttgggaaacgctctcgcttcttccccacaaaacttggtgacttccccaaactaaatcacaccttttcctatatatatatatatgcatatatatatagatctatagacagtatatatatattttgagtacggatcatgggaccaaacttttccgacttccttccatccgagtagagtgaccctgggccggtcactcagcgggggacacaggaagggctgaggttggcgggaccccgcgcaacacataccaggtgccccacccccacccccaccacctcctggctggcacatcccaccaggaacccgccaacacaacatacctccaggacttttggcaccccccaccaccaattctccagggccgttgggctctgccagcttcagtgtccctggtcccagctgcagcctccagaccccacctcgccccttcgtcccagagccctgccctccgggatggatataggtacaacagagacgctctggcctgcctcagcccttctctgctcccctgcccgagtcatagccttactcatgtgaccaatagcccttagctttccgtcggagggggggggcggacagggttggggggagcccccctgcccctcaccaccccctcccaaggccaggcagccattgtccctgcccttcgaatcaccagcctcgaatttaaggtcttgtaaccaggattgccaagcgtagcggaagaccctacccggaccggccaagcacccctttaactggagacgaacttgataatgaccttcatacctctacagagatttttttttttttccggtctttctgagcaggtacaaagaagaaaagagaagaaaaagatggggggaaaaaatcaaaccacaatggatttttgtttcctagttgggagtggggtggggtggggtgtctttgtgagggtgcctctgtacagctgcccaatccgcgacacccacgtcaaagcacagcatcaagttcgtttggacatccggcaaggcctcttaccaaatgaggcgccagataacttaataagctcaaaagaaaaaaacatttaaaaagaaagaaaaaaaaa

SEQ ID NO: 29525 - DNA, 1555 bp, Homo sapiens
  misc_feature (1551)..(1551): n is a, c, g, or t
cgcccgccatggcccgcctgacggagagcgaggcgcgccggcagcagcagcagctcctgcagccgcggccctcgcccgtgggcagcagcgggcccgagccccccggggggcagcccgacggcatgaaggacctggacgccatcaaactcttcgtgggccagatcccccggcacctggacgagaaggacctcaagccgctcttcgagcagttcggccgcatctacgagctcacggtgctcaaagacccctacacggggatgcacaaaggctgtgccttcctcacctactgtgccagggattccgccatcaaagctcagactgccctgcacgagcagaagaccttgcccggaatggcgcggccaatccaggtgaagcctgcggacagtgaaagccgcggaggtagggaccggaagctgttcgtggggatgctgaacaagcagcagtcggaggaggacgtgctgcggctgttccagcccttcggggtcattgacgagtgcaccgtgctccgggggcctgacggcagcagcaaaggctgtgctttcgtgaagttctcctcccacacggaggcgcaggcggccatccacgccttgcatgggagccagaccatgccgggagcctcctccagcctggtggtcaagttcgccgacacggacaaggagcggacgctccggcgcatgcagcagatggtgggccagctgggcatcctgacgccgtccctcacattgcccttcagcccctacagtgcctacgcccaggctctcatgcaacagcagacaacagtcctgtccacctcgggcagctacctgagtcccggcgtggccttctcaccctgtcacatccagcagataggcgccgtcagcctcaacgggctgcctgccacacccatcgctcctgcctctgggctgcactcacccccgctgctgggcaccaccgctgtgcctggcctcgtggctcccatcaccaatggctttgcaggtgtcgtgccctttccaggtgggcaccctgccctggaaaccgtctatgccaatggccttgtgccctacccagctcagagcccgactgtggccgagacactgcatcctgccttctccggagtccagcagtacacagccatgtaccccaccgcggccatcacgcccatcgcgcacagcgtcccccagccgccgcccctcctgcagcagcagcagcgagaaggtcccgagggctgtaacctgtttatctaccacctcccccaggagtttggagacacggagctgacgcagatgttcctacccttcggcaatatcatttcctccaaggtgtttatggatcgagctaccaaccagagcaagtgtttcggcttcgtgagctttgataacccggccagcgcccaggcagccatccaggccatgaacggcttccagatcggcatgaagaggctcaaagtccagctgaagcggcccaaagacccgtgaagggggtttctcccctgtcctccatcccccgtttctgttcattcacagctgcgtccccgagcactggaaacaggcctagcacataatagatgctcanacta

SEQ ID NO: 29526 - DNA, 2509 bp, Homo sapiens
cgggcggcggcacgtggatgccagcctggcgcgcgtctccaggccggtggatggcgcggccaatccaggtgaagcctgcggacagtgaaagccgcggaggtagggaccggaagctgttcgtggggatgctgaacaagcagcagtcggaggaggacgtgctgcggctgttccagcccttcggggtcattgacgagtgcaccgtgctccgggggcctgacggcagcagcaaaggctgtgctttcgtgaagttctcctcccacacggaggcgcaggcggccatccacgccttgcatgggagccagaccatgccgggagcctcctccagcctggtggtcaagttcgccgacacggacaaggagcggacgctccggcgcatgcagcagatggtgggccagctgggcatcctgacgccgtccctcacattgcccttcagcccctacagtgcctacgcccaggctctcatgcaacagcagacaacagtcctgtccacctcgggcagctacctgagtcccggcgtggccttctcaccctgtcacatccagcagataggcgccgtcagcctcaacgggctgcctgccacacccatcgctcctgcctctgggctgcactcacccccgctgctgggcaccaccgctgtgcctggcctcgtggctcccatcaccaatggctttgcaggtgtcgtgccctttccaggtgggcaccctgccctggaaaccgtctatgccaatggccttgtgccctacccagctcagagcccgactgtggccgagacactgcatcctgccttctccggagtccagcagtacacagccatgtaccccaccgcggccatcacgcccatcgcgcacagcgtcccccagccgccgcccctcctgcagcagcagcagcgagaaggtcccgagggctgtaacctgtttatctaccacctcccccaggagtttggagacacggagctgacgcagatgttcctacccttcggcaatatcatttcctccaaggtgtttatggatcgagctaccaaccagagcaagtgtttcggcttcgtgagctttgataacccggccagcgcccaggcagccatccaggccatgaacggcttccagatcggcatgaagaggctcaaagtccagctgaagcggcccaaagacccgggacacccctactgaccgcgcccacagccgccctgaggctgtaggcatggcccaggtgaggggccttcccatcccaggagggttttctgcttccaaccgatccaggacttacccataaattccaaccgttctttggacaccagccctttcctcccctcttctccccttgccctgcccctctactggaggccacctggagtggcgaggggcctttggggtctgtcctggggcaggggcgggggtgggggaggctcctgaatcgtgggcagaagtgttcacacgccccccctgctttgggaaacgctctcgcttcttccccacaaaacttggtgacttccccaaactaaatcacaccttttcctatatatatatatatgcatatatatatagatctatagacagtatatatatattttgagtacggatcatgggaccaaacttttccgacttccttccatccgagtagagtgaccctgggccggtcactcagcgggggacacaggaagggctgaggttggcgggaccccgcgcaacacataccaggtgccccacccccacccccaccacctcctggctggcacatcccaccaggaacccgccaacacaacatacctccaggacttttggcaccccccaccaccaattctccagggccgttgggctctgccagcttcagtgtccctggtcccagctgcagcctccagaccccacctcgccccttcgtcccagagccctgccctccgggatggatataggtacaacagagacgctctggcctgcctcagcccttctctgctcccctgcccgagtcatagccttactcatgtgaccaatagcccttagctttccgtcggagggggggggcggacagggttggggggagcccccctgcccctcaccaccccctcccaaggccaggcagccattgtccctgcccttcgaatcaccagcctcgaatttaaggtcttgtaaccaggattgccaagcgtagcggaagaccctacccggaccggccaagcacccctttaactggagacgaacttgataatgaccttcatacctctacagagatttttttttttttccggtctttctgagcaggtacaaagaagaaaagagaagaaaaagatggggggaaaaaatcaaaccacaatggatttttgtttcctagttgggagtggggtggggtggggtgtctttgtgagggtgcctctgtacagctgcccaatccgcgacacccacgtcaaagcacagcatcaagttcgtttggacatccggcaaggcctcttaccaaatgaggcgccagataacttaataagctcaaaagaaaaaaacatttaaaaagaaagaaaaaaaaa

SEQ ID NO: 29527 - DNA, 1861 bp, Homo sapiens
ttcctggtcctacagagggtttagcacagaggagaagctgggcggggtgtttgttgctgtccttgcggctcttaaggatcgggggtggatggaagacttctgctgctcccgccccactcagcccctctgtctgcccgcagctcagagcccgactgtggccgagacactgcatcctgccttctccggagtccagcagtacacagccatgtaccccaccgcggccatcacgcccatcgcgcacagcgtcccccagccgccgcccctcctgcagcagcagcagcgagaaggagtttggagacacggagctgacgcagatgttcctacccttcggcaatatcatttcctccaaggtgtttatggatcgagctaccaaccagagcaagtgtttcggcttcgtgagctttgataacccggccagcgcccaggcagccatccaggccatgaacggcttccagatcggcatgaagaggctcaaagtccagctgaagcggcccaaagacccgggacacccctactgaccgcgcccacagccgccctgaggctgtaggcatggcccaggtgaggggccttcccatcccaggagggttttctgcttccaaccgatccaggacttacccataaattccaaccgttctttggacaccagccctttcctcccctcttctccccttgccctgcccctctactggaggccacctggagtggcgaggggcctttggggtctgtcctggggcaggggcgggggtgggggaggctcctgaatcgtgggcagaagtgttcacacgccccccctgctttgggaaacgctctcgcttcttccccacaaaacttggtgacttccccaaactaaatcacaccttttcctatatatatatatatgcatatatatatagatctatagacagtatatatatattttgagtacggatcatgggaccaaacttttccgacttccttccatccgagtagagtgaccctgggccggtcactcagcgggggacacaggaagggctgaggttggcgggaccccgcgcaacacataccaggtgccccacccccacccccaccacctcctggctggcacatcccaccaggaacccgccaacacaacatacctccaggacttttggcaccccccaccaccaattctccagggccgttgggctctgccagcttcagtgtccctggtcccagctgcagcctccagaccccacctcgccccttcgtcccagagccctgccctccgggatggatataggtacaacagagacgctctggcctgcctcagcccttctctgctcccctgcccgagtcatagccttactcatgtgaccaatagcccttagctttccgtcggagggggggggcggacagggttggggggagcccccctgcccctcaccaccccctcccaaggccaggcagccattgtccctgcccttcgaatcaccagcctcgaatttaaggtcttgtaaccaggattgccaagcgtagcggaagaccctacccggaccggccaagcacccctttaactggagacgaacttgataatgaccttcatacctctacagagatttttttttttttccggtctttctgagcaggtacaaagaagaaaagagaagaaaaagatggggggaaaaaatcaaaccacaatggatttttgtttcctagttgggagtggggtggggtggggtgtctttgtgagggtgcctctgtacagctgcccaatccgcgacacccacgtcaaagcacagcatcaagttcgtttggacatccggcaaggcctcttaccaaatgaggcgccagataacttaataagctcaaaagaaaaaaacatttaaaaagaaagaaaaaaaaa

SEQ ID NO: 29528 - DNA, 308 bp, Homo sapiens
gccccgcccctcaggcaatagcccctccccgtttcgtctgtgatcttggccccgccctctggcctggccccgcccccaaaccctccccacaaaggccatgatcacacccactcctgccttggccccaccctcttatggccccgccccctccccgcccagcggcccaggccgcccacgtggcctcacgcccctcctcgccctgtgtctcgctccggtctccgcagccatgtaccccaccgcggccatcacgcccatcgcgcacagcgtcccccagccgccgcccctcctgcagcagcagcagcgagaag

SEQ ID NO: 29529 - DNA, 646 bp, Homo sapiens
cataattttttttttgagaggggatctcacgctgttgcccaggctggagtgcagtggtaccatcatagctcactgcagcctggacttcctgggctcaaccaatcctcccacctcaacctccccagtagttgggactacacatatgcaccactacacctggcttttcttttttttttttctttaaatagaaataaggtctcactatgttgcccaggctgtatgtaaccttttttattagttcgttcccttcaaaatacacattttttgtaacagaactgaaaatcatccatcaaaaccttcaaaaaaaggtttgatttcttcatcctgtactaatcaatccaaacataacatgctgttttatatacacacaaatagcaggaagaagtatgcctttgtgttgaaaacaataagtgaaacaaaaaaataaaaataaaataaaaaatatatgcatacatacatatacacatacatgtagagaaagggacttaactcactggctccagtaagcatctagaggtctgcctccataggctcagcagaggatccagctagagaaaacttattttatttttttgagacagagtttcgttctgtcacccaggctggagtgcagtggcgtgatctcagctcactgcaacctccacct

SEQ ID NO: 29530 - DNA, 383 bp, Homo sapiens
ctggactcaactgcaaagatggctaccagcttttggggccccctcacacagagggctatccacttcacgtcccctctcattgtcaagagcttttctgttgctcaataacattcttctctgccttcctcactctctggtgtccacgtacctcattattcttggtcactggacaaaaacccagaactcgccaaacggtgggaacaaagaacggctgtaacacgcacctggctggctcctggagctgtgggcagtgggcatgaaaagagctgttacacactcccaattgctggaatatgggagtgatgagccgcgacccctctgggggcccaaacatcaggacccctcgaactagaaccataatacacccccattcacaaagccat

SEQ ID NO: 29531 - DNA, 1453 bp, Homo sapiens
atattctggtaactgaaacacacttaaggtgttggatgcctgccccatcacgctgcactgtctgctgtcacatgtgtcctgaactcaccctgtttttgccctgggtttcccaggataccaagcccctgaggatggagatgatgcaacaaacctcagctttgcttggattgtgacttgaaccctatttctcaatggtgaaaggctagcctgcaataaaagctgcttttaaaacagaagtaaagcagctttatatatgggactcactagatatgagggtaagtagccccaccacatgtaaaacttggtcctcaaacgtttctgcagaataagaagccaaacttatggttatcttgtttctgttagaaacaaagttgtatatagaaataacttcgtcagaatcgacacaaatcacatcgaatagttgactgtttaattccttctacattcaaatatctaattaaaatactgtgtgctttgttggaagcatctgctcaaacttttgactgttgtaaatatgcatgcagctgggaagggattcatctaagggataagaaatgaaaaagacactctaaggacctgagggaattcaaatagaggacttcgattttttaaaaagaatgacgtggaaatgatctgttttccttgtaaaatcatatctcgtagaaaacattttaccactaccatcacccctagttggttgtgaagtgattgcctcttatccctgaaaggaaactcctgttctgaaaagttgggatgcattagccatcagtgttaggtgacgtctgttgtagtctgaagagtccttaaccttgattaaggaaggcttcctgggagaggtgggcttttggggcaattatatgatagagaagagagagaaaaatggcagatggaagtgggagacaattccacacacagggggtggagaatgatgtggaggcagcagtgggtgtaaggacaatggtgccaagagatttatttggctagaacacaaggggcagctgggtagttaggagtgggaggatggtaggacagtctgacagaaaccttggaaacagttgaactctgaaaagctgatggcaaatcagatttcatgaggaaaatggcatggttgaaaatagtaatagaaaaataagactgaagttttaaatgactggatttttgaaagtaggattattatttctttggtataccgaactttgcaaagatacgtagcattgcatccttcctctttgcttctagacagggttggccataaaccaactacactgatagaggtctctccagattgtctcagaagagagagtttaccctgaaacttaatgacatgaataaaacctgtttactgaaatttttattgcaatttaacgttaaaagtttctgctggagttttatgcatatttttctctctaagtggtgggaaataaagaacaaatctctttccaaaaaaaaaaaa

SEQ ID NO: 29532 - DNA, 960 bp, Homo sapiens
atggaaagaggaaaccaaacagaagttggaaactttctcctcctgggattcgcagaggactctgacatgcagcttctcctccatgggctgttcctctccatgtacctggttaccatcatcggaaacctgctcatcatcctgaccatcagttcagactcccacctccacacccccatgtacttcttcctctccaacctgtcctttgctgacatctgtttcacatccacgactgtcccaaagatgctggtgaatatccaaacacaaagcaaaatgatcacttttgcaggctgcctcactcagatattttttttcattgcatttggatgcctggacaatttgctcctgaccatgacggcctatgaccgcttcgtggccatctgttaccccctgcactacacggtcatcatgaacccccggctctgtggactgctggttctggggtcctggtgcatcagtgtcatgggttccttgcttgagaccttgaccattttgaggctgtccttctgcacaaatatggaaattccgcactttttttgtgatccttccgaagtcctgaagctggcctgttctgacaccttcatcaataacatcgtgatgtattttgtgaccattgtcctgggtgtttttcctctctgtggaatcctattctcttattctcagattttctcctccgtcctaagagtatctgccagaggccagcacaaagccttttccacctgtggttcccacctctcagtggtcagcttgttctatggcactggccttggggtctatctcagttctgcagttacaccaccttctaggacaagtctggcagcctcggtgatgtacaccatggtcacccccatgctgaaccccttcatctacagcctgaggaacaaggacatgaaggggtcactggggagactcctcctcagggcaacgtctctcaaagaggggaccattgctaagctctcatga

SEQ ID NO: 29533 - DNA, 121 bp, Homo sapiens
taaataactaatttcttagcggtactatgcctttacgttgctttaccactgcaggttgccgatggacctgtaacttacttcctgaacattataaaaggacagctgaccagattccttttga

SEQ ID NO: 29534 - DNA, 394 bp, Homo sapiens
aagagaaaatcagaattctcttctggaacctacattgggactgtcctcagagcaggttgtgatgtgaggaatcaaatctacaggggtatttcgcagcttggagcgcagcagactgttcccgaccccatgcatttgggggtgagaccagagacagttgaaaaactatggaatcttgacattctgcactctcaagcctggcctctccctgaatttcacagattaacatcagaccaatttattccgactattaaaagtattagaacaaaaaccaaggaggaccagtgagcagaagcaataaaccattaaaatggacatcctaaagatttaaaattttgccatcataagatgtgaacgtttgaagagctgcatttaaatgaatacaagaagggactga

SEQ ID NO: 29535 - DNA, 293 bp, Homo sapiens
ctactactactaaattctcggccgctacgacggcagagctagtctctaattcttgggctcaagctatcctcctgtctctctctgtgtctgtcttctgtcttactgtctttctctgcctgtctgtctgtctctctctctccttgcctgtttctctctctctctgtctctgtttctctctgtctccctctgtctgtctctgtctttctctctctgtctctttctctctgtctgtctctctctttctttctctctgtctgtccatctgtctctgtctctgtgtgtgtgtgtgtttc

SEQ ID NO: 29536 - DNA, 1801 bp, Homo sapiens
gcttgcaaactgctttccttgctccgtcgctcctggcctccgcttccctccctcctctttttcctcgcctcttcttccttcccttcccctgtccttctgggtaactccgggaggcaaaaagggaggctgcccgctcgctcgccccgctggctctcttccatcggcctcggtcttttagattccctgccttcgagccgaaccgagatttggaaggaaaaaatgcaagcgaactctttgggtttttgtttttgtttttttggtcataaatccagatgagatgaagtatcgtgtctactatttcctttcagagccgtgatcttcctaacgagagccgagtgttttggtgttccctgcccctgtgttttggggagcttgggggcggggatgttgaacactttgaaaattattctttcttggttgtagtcgagggagtcgggaacctccgcgcgctctccctgctcatcccgaggagagagactgatggcgggacagggcttcttggggtgggtgggaaaggggtgcgcactgcacctgcgatgccttttcagtgtgcggggggactcagggaacctcgacaggacagcctgggagaacgagaaaggtggcgggatttctggccgctgcggtgtttgtattttgggcgctgcgtgactctgtgttggctcccaatggctgttgcctccctttcctaaattttattttattttttcccatggtgcaagctctgtaaaaagggaactgcgggcctgagcgtagtggacgccaggcttcagattcccgaggtccttaccttgggcgaggagaaagacgaacagagccccagcccgcgttccttatgtgcaagactcaggaggagagaagggcactttgtggccgtggctgaggggacccggcgcgggaggagcgggcgcgggcgcgaaagggagatctttgtgagtgattttgcaaaaatagattgcgaggttggttggatttgcaacctgtggctctcctcgagggagtaagaatgggggaaggcgcggcggcggcggcccggggagggagtgggtagagttggagcctcagaaatcggctgagctccgggggcgggcggggagaaagggcgggggggcagcaggagctaggggccaccccgctgccggatgtagtgaccgtggtaaatgtcttgagaactgtgggttgcgttgcctttatgatgccgtgttattggaaccctggcgaaaaatggaactagtgttgcaataatgagttttaaagctcccccatggaaaacaaaaacacaaccaaaccgatttttaaaaaaaatgaaaaaagaccctctgtgttgtgttcccttctacgatggttgtgttggtggctggggtttgggggtggggggtcctgacagttgagcagataaatgaccccaaaccaggtgctgaaagtcccaagctgtcacagggcccctgaccacctcagagagccaatctccactccgcgccccctccccgccggcccccgccaccccacaacccgccaggatttaatcttttatggatttttttttcagtttatagtttccaggaggaaagtcttgtaacgctttactttttctcttctttttttaaagtaaagtgagtgtcagtagatgtgttttttacagtctggattttaaaaaaagtggggcaggagagagggaaccagggaaagggctgtttagaaatacagtttgtggctctgagcgatgccaccggcttcctctacagagactgccagtttccctttttctttgcaaggtgtgtgtggttttaataaataactt

SEQ ID NO: 29537 - DNA, 567 bp, Homo sapiens
agtggcatgatcatagtttactataacctgtaactcctgggctcaagcaatcctcttgcctcagactccctagtagctaggactacaaggatgcctcaccacacacaactaattttttaaagaatgttttgtagagacagggttctgtgatgttgtcctgactggtcatgaattcctggcctcaagtgatcctctcaccacggcctcctgaagtgcagggattgcaggcatgagccactgcacccagccccaaatcatttaaaataataatactaaatctatcatattactatagtataaataacatttttatgaaaaataactattttcgaaaatcagaaaaaaagtatgaagagtggcattatatcatatttttataaatcatttcaatgtttggcttaatagaagacagctagattcccatatatacttttgcattcagtatattctgatatcacacattacattatgtagcctctgcaaaagtccactacattacactcatgagaacatgagaatgaaaaagttaaataatgttttagtatgattatgaaaacaattttcacc

SEQ ID NO: 29538 - DNA, 355 bp, Homo sapiens
ttttactaatatctgtaaagaacagagctttctgttgttgtgtttgtttgtttataactggaagagaaaataacaaaaggacattgtgtaaatctcacccctactctcctgaaatatacaatacaattacttttaggaaatgcactttttttcccccactgatccaaacaagactacatataccttaatatttaagaaattgacactgatattaaactcaacattacatgtttgctcaaagatgagttaattataaaaaaaagaaccatatcctaagcatttcaaattgattatttttagagatattagaattatttggtttaaacctattaaaatgttattaccatagaccttt

SEQ ID NO: 29539 - DNA, 422 bp, Homo sapiens
catcacagaagccgacttaaaaattacattccccatacttcctcaaagctagtaaattaggttccgccagtaagatttccttgtgtgtgatctggaaggtggaagtgaagctgaatcttcctgctactatttctactggcaagcaataccagggaatcatgaagggcaaaaggacactccataggccaatccagtgccccatcactaactattaagatgttgagaaaagtttctgaggcctcagcagtggcttcctaatcacatcttccttatccctggattgtggctaaccagcctgaccaatatgatgaaaccccgtctccactaaaaatacaaaaattagtggggcatggtggcatgtgcctgtaatcacagttactcgggaggctgagacaggagaatctcttgaacctgggaggcag

SEQ ID NO: 29540 - DNA, 439 bp, Homo sapiens
ctgcacaaatcaataaagccttttctgtcagccccaggtaaattccaattccaagcaacttgggcaaggaaacaaacaagtgaaaaaaaaaatcacattggctttaagatgctaaatttaagacatgcagttggagctgacagctgacaggttatcaaccagaaatcattctctgatcacttattcaacaactccaaaagaattgcagccacatgaggcttgtaacgaagagggctgtatttccaaggaggataacagaagggcacatgtggaatgtggataatttccagaagatactgagagacagtgctggtttctgacttcttattctagggcaatgccttttgatgtcctgattcaatgccgttgtaagcctgaactaatctgatgtaataaaagcttaattgtctacttgcaattatcatttccctttaatctg

SEQ ID NO: 29541 - DNA, 543 bp, Homo sapiens
ttccatatatatacttttttctacttgtatacatctttcaatgtcaaatatatgcccatatatatatatggaatgtcattttaaagtctgtatgggtattgtattttatgaatgtatcaaattatcctcagtcacttattgctgattatttctggttttcggtattataaacaaaaccacattacaaatcactgagtactgtacaattgtctaatgttttcttgatttctagaagaaatgtgcacgttaaggcattttataagactgcctcactgacctccagaaaagctaggcaatttacacgcctatcatctgtatttaagtatccatttctctctgcactaggtatagtttgtcatgtttacatatttttaatctgactgaaatacttcaatttttacttactgttaatttgaaatcctgacatattcatttactatttgtatttgcttcatggattatatgttcatagttttcacccatttttctgcttaagtgtatcttattgattttttgaaaaatctttataaatttaaaatcgtc

SEQ ID NO: 29542 - DNA, 477 bp, Homo sapiens
agagctcaagcaatccagctacgtcagcctcccaaagtgctgggatgacatgcatgagccactgtgcacagccaatatggacattcttgttcttcagtatccatttgtaagaccatactttaattcacctttttttttttttgaaacagtctctctcttgtcacccaggctggagtgcaatggtgcaatctcagttcactgcaacctccatatcccgggtttaagcaattcttctgcctcagcctcccgagtagctgagattacaggtgtgccaccgtgcctgggtaatttttgtatttttagtagagacagtttcaccatgttggctaggctggtctcgaactcctaacctcaggtagtccacctgcctcggccttccaaagtgctgggattacaggcttgagccactgcgccaggccatattttttttaataactaataattgtttttacaattaattgtagttgtaaaaaatcg

SEQ ID NO: 29543 - DNA, 867 bp, Homo sapiens
tccacatctagagttgactctagaaggctgaggaatgcgaggcccagcttcaggtccaaaactaccaacttaggccctcgatttccctccttcacgacccagttccttcgagtctggaagactctgcaataccctttgtgaaggtgttaaaaagggtgactcactccccagagcgagtcacacctggactcttaatgccttcgttgttggatggcatcctgcttcctaccaggttatcctggcctcagtgacctcagaagcagcaagggtctgacttacagtgggcacgtgctacttctttaattaattgaaagtaaagttgttgtttttaagttggcattctggcttgaaaacagaaagatggcatgaaaatattaatgggagtacttcaactattttcattatgccaaaaatacttggagaagtagcacattttctgcaaagtctaaaatgtcaattttctttggggccaaaaatgcatcatttctgtgtggtaatacttatgtggataaaaaactctggtagacagttatgcatatatatattttttggtgaattacaatgagaaaaagtccaggtgcaatggctcacatctgtaactccagcactttaggaggcggatccaggaggatggctttagcccaggagttcaagaccagcatgggcaacatagtgagacacctctgcctcccccaccccaccccgcctctacaaaaaaatttaaaaattagctgggtgtggtggtgtgcacctgtagtcccagctacttgggaggttgacgcaggaggactgcttgagcctgggaggcagaggttgcagtgagccaagacagcaccattggactccagcctgggtaacagagaccct

SEQ ID NO: 29544 - DNA, 777 bp, Homo sapiens
acatggtgcaacatttgataatagtatcaatttacgtttgtctttcccttgcaatttccctcctcctctagcttgctcacgtttctgccttcttcttgctggcaagagtacagactataattctccagttcactaacatctggagcgactgcactgtttgcaatttcattgattgactacatgtgtacagttcctttattgcaagtcacttttctgtataatcttttttgagacgaagtcctgctctgtcgcccaggctgcagtagcgcaatcttggctcactgcaacttccgcctcccgggttcaagcgattctcctgcctcagcctcctgagtagctgggattataggcgcccgccaccatgcccagctaatttttttgtatttttagtagagatggggtttcactatgttggccaggcttgttttgaactcctgacctcaagagatctgccagccttggcctcccaaagtgctgggattacaggtgtgaactactgtgcctggccatataatctatttttaaaatgtttttatatgaaaataaacagagacagagtctcactgtgttgcccaggctgatctcgaactcttgggttcaagtgatcctcccaccctggcctcccaaagtgctggggttacaggcgtgaaccacctcatgtggcctcgctttcctatataatttaaacaatagaactatagtgccatttgtagagtttcccagtttatactgcatgtagcactccccatagtcgtatgttctcacagcagaacggaa

SEQ ID NO: 29545 - DNA, 310 bp, Homo sapiens
acatggtgcaacatttgataatagtatcaatttacgtttgtctttcccttgcaatttccctcctcctctagcttgctcacgtttctgccttcttcttgctggcaagagtacagactataattctccagttcactaacatctggagcgactgcactgtttgcaatttcattgattgactacatgtgtacagttcctttattgcaagtcacttttctgtataatcttttttgagacgaagtcctgctctgtcgcccaggctgcatgagccaagacagcaccattggactccagcctgggtaacagagaccct

SEQ ID NO: 29546 - DNA, 479 bp, Homo sapiens
tagccaatgttttcttgtttgtgtctctgtatcctacaacggtgtgaagaactaagatcaaattcatgaaatgaacatttactacactgtccgggattacattcgttatctcatttaatgctcataacaaacctttgaggttatcttttgttccaactttacacatgagaaaatgcaggctaaaagaggttatttaacattgcccatagctggtggatatcagagcctgaaatggaacccaaaattgtcagattctaaattccttgttattagcctcagtgttatatgggagtctacagcatcataaaagatgttggctcctatttatttgcctccctctctttccactcaaagggcttgaagctctcacttgtggctaagatcttgggtactgggataagctctctgaggaaaagtcatacctcatctcagtgctacatagattgcagtatgttcagacagagagttagtggaagagt

SEQ ID NO: 29547 - DNA, 2529 bp, Homo sapiens
agacactggccgcgggccaccatctggacgcgatcccccgctagggcctccctggtctgggccaaagttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagaggcgtggggagcagagcggcgctgaggggagggcagaggaggagagagcctggcagcggaggagcagaggcgggcgccgcaccgccccgcacgctcgctcgctcgggagagtcgcgggcggccgcttgggcgcacttgccgggtcaccttgtcccggaggagaaatggcttccctgaggcaagtgtaacctacattcccagcccaccagcctgacgcccagccagggagagagtaccatggatggcatcattgaacagaagagcatgctggtgcacagtaaaatcagtgatgctggcaagaggaatggtttaattaacaccagaaacttgatggccgagagcagagatggtctggtgtctgtttacccagcgccccagtaccagagccaccgggtgggggccagcacagtgccggccagcctggacagcagcaggagtgagccgatgcagcagctgctggaccccaacaccctgcagcagtcagtggagtcccgctaccggcccaacatcatcctctattcagagggcgtgctgcgctcctggggggacggtgtggccgccgactgctgcgagaccaccttcatcgaggaccggtcgcccaccaaagacagcctcgagtacccggatgggaagttcattgacctctcagctgatgacataaaaatccacaccctgtcctacgatgtggaggaggaggaggagttccaggagctggagagcgactactcaagcgacacagagagtgaggacaatttcctcatgatgcccccgcgggaccacctgggcctcagtgtcttctccatgctctgctgcttctggcctctgggcatcgcagccttctacttgtcccatgagaccaacaaagccgtggccaagggggacttgcaccaggccagcaccagctcccggcgggccctattcctggcagtgctgtccatcaccattgggactggcgtctatgtgggcgtggccgtggccctcatcgcctacctctccaagaacaaccacctgtgagcttcctgcgaatggagggggagcacccggggccaggtctgtgtggacgtggaggaagcaggcataccgcatgatgctgtacagtacaaatgattgccaaatgatgccacgaagccctgggatttcctacccatggatttattttgtttttatcctttaatttcatgttcacagcactgtgtagagcaccagacagacgggcactgctaatccttccaaaggaaagctccaaagatcccagcccgcaaggctgtctctggatggattctggtggatgaatggcaacgcggctctctgcagcctgccagtgcccagagtgccaccgcattagcaatatacaaacagtccaaaaaagtgtttattttttatggaatacggtgcaataggcagaggacaagggacacatcactcttctgtctgtggccctgctggagtcctttgtgccccccggagtccacacgccttccctgcaagacgagaatggggctgggaagaaagaggcaacaccacggctggcaggagccccgctgcactgctctgcagacccattggcctgaccctgagaagcagagccagcaaagcccgggacctgcccctctttctttcccttcacaccaccccagcctcaggatgtcaagccacctccggaacgtgtctacactccacagctaccccgcagcaatacgcactcttgggacctcgctgatctaggatggggaggcaggccaccgcccctcccaagactcctcaagaaagagccccgcggttgctccggaaactcgaggcactgcagctatgggcactgcctcagcctaaagacacaggggcgcctcccaatcaccgcgctggcggatgctcaccccgtcataagcagaaactagtgatcctggaaatgagatgggccttactctgtcgactaaatgaatagctattttcttgtcattttttaaagtgcaactcttgcttcatgctgcttaagttaccagatgaatgctgagaaataagtaatcacagacattttaataccatttcattgctgttttacgagtgttcattacttaacaaaaaattatcttttagctttttcgcttaagacttttctttctgatgaatagctgt

SEQ ID NO: 29548 - DNA, 393 bp, Homo sapiens
gccttctctgcatcaacaatgcctttttctgaatcaggagccgtagatgagccctccactcactgcttgttccgacttgcttacaatgacttcctttttcttctccaactctgcagaccaacaaagccgtggccaagggggacttgcaccaggccagcaccagctcccggcgggccctattcctggcagtgctgtccatcaccattgggactggcgtctatgtgggcgtggccgtggccctcatcgcctacctctccaagaacaaccacctgtgagcttcctgcgaatggagggggagcacccggggccaggtctgtgtggacgtggaggaagcaggcataccgcatgatgctgtacagtacaaatgattgccaaatgatgccacgaagccct

SEQ ID NO: 29549 - DNA, 854 bp, Homo sapiens
ttccgcctcgagcgtgtggcgggattgcggaagccctccacagttcataaccgttggctggttatgaaccgttcataacgggcgttaataaccataccctgttagactaagcatggtccacccgcgaatcctctacagagatggccaagcgctggggtcgtggctgcgtcctctaggccaggccttggtgggcagctgttgacatgtccagaaccccaggaagtgctgaaggtacctgcagttcaggccccatggaagcccagacctccttcacccttcggggacactgaaattggccaaatgtttaggccatgaggatggctgctgagtaagcccataatccctacatcggacacaaccttgtgcaaaggaccttctcaccacagatcagccagaccatcttcctccttccaagtcatcaaagagttccaagctggtcacctgtcccttgatgttcccaggaaaccaggaaagaggacccctgcattttatcttcccatccagagtggcaggatctctgcctgggaaacaggcttcattcagcacagctgtggtagcatttaaacaaaaggcaaaaggttggggcaccaatgtacgcaaacgttgaaagctaaaaacatttcaaagaaacctcccaggtcttggtgtcctgtgcgatggttcaacgccggcggtggaacgcacttagaaccaaatgggacagggttgcactggaagcgcacgtgaataaacctttggcaaagcaaccaaggttttataaaaggtccacaggtggaaatacccaaaggaaattggcaacggcacgaacagggcaaaggggtgccttgtgattttgcaaccttaaaggaaaaaaa

SEQ ID NO: 29550 - DNA, 2525 bp, Homo sapiens
ttccgcctcgagcgtgtggcgggattgcggaagccctccacagttcataaccgttggctggttatgaaccgttcataacgggcgttaataaccataccctgttagactaagcatggtccacccgcgaatcctctacagagatggccaagcgctggggtcgtggctgcgtcctctaggccagccttgtgcaaaggaccttctcaccacagatcagccagaccatcttcctccttccaagtcatcaaagagttccaagctggtcacctgtcccttgatgttcccaggaaaccaggaaagaggacccctgcattttatcttcccatccagagtggcaggatctctgcctgggaaacaggcttcattcagcacagctgtggtagcattaacaaagcaaagtgggcacatgtagaagttgaagctaaaacattcaagaactccagtctgtttctgtggatgttaagggggtgaagataaaacaatggaggtgatgaggaggaataacttgaagacagtttaaagccacagtgatacaaagaatgaagagaaggaaggtgctggattttactaagaaaacagactgagttcaggagtctcaccagtagaactttatagtattgcgtttcgattacatgtgtgtgaattttaaaaactgattaccctccagtaaaaatgtggaaccaatttgcatttggattaaaacattaggtttggggacaaaagtggaccccatgctgcctgagatgaagagagagagcaggatggcagaggaatcaccagctcaagaaaccccaagacttggacagtcttccagcagaagaggccagggtctctcagtgtactactccaaacaggcctctcctagagatgtagtctgggaaggtccaaaacccaccagacaggcacatccagtggggaaaagacttcccattccagtgtggcctgcatccctcacctctgcttcccagtcttctgctgacctcagaggagcagggtggccattgctgatctgggttagggagatgccagaaacacacccaggtttgaaccacaggttagtggtacaaagtcacagtccttgtgccttcagaaaacccagaggccccaaatacgagtgggaagagagttgggaaaaactgaaccagactcttccaatggccattaaagagaaaattcagcaacgcttgcctttgtctttgaccctgagaagttaagggacacagattgtggcgccgtgatggaacatggagggaaggcatggtgtgcttcctgcagagatgcctctggagtccctgtggccacgggatctcactggccccctcttcaggcaccttgatggggctcagtggggccaggccgaagggtggaagtagaaaagcatcaacaggctgtccagatcaattggcaccatccaaggccctgctgcacccacacatggaggtcaccagctcagccccaggggttctttcacacacaagctccttccctaaggagtcctgtggggttccacactcagtgtgctgcccaagtcagagatttaccacagatctgtctccccctcaacctggactcaagttactgtggtgagaaacctcactgtccatggttaactgaagaaatccctccttcagaaagaacttgagtagtagatgaggtggttagacaggatctttttccctcaagctgtttggacgccacagccaggaccaactctgacagctgcgagagagagagcccctccaatgtggaacctcctacacagccccccttttgggtccctggatatgagcccccagcaggaccaccactctagggggaagtctccctcccatccctcagatccccacattgttcctcctgtaggagaaaagtcagccctgcccctggagcttctccaagatggcactggactcgccgttatcttgaggagccaggagctgaaatggctccggcttagcaacccagtatggccaaagtggaaaggttctctgtcctttgcagtcaccaaaaaaaaaaaaaaaaaaaaaaaaaaaaaaaaaaaaaaaaaaaaaaaaaaaggggggggggtaaaattttccccgggggggcccacacgttaaatgcacgctaccccatgcttttagtagtaagaaagggggccgccccattgaatgggggcgcggcgattataataaaagcaagggcaccgggcgcgcggcgtgtttaacaaacggctggcggagtggaaaaacactgcgatgccgtgggacatcttggtggagagggaacccatattatgctgtggggggggggggcacatatatgtggggcacaaaatcatcctatcagaagaaatatttatagcgccttgagggggaaaatatataaatttttcagaggtgtttaattagggtggtttacacaaacgcggtataattgacgtggagatggttgaagaaaaatttgtgggtactcagggggagtatgtagttttgatgaaaaaaatttttatattaccaggagggactttttataatataatagaggtg

SEQ ID NO: 29551 - DNA, 2702 bp, Homo sapiens
ttccgcctcgagcgtgtggcgggattgcggaagccctccacagttcataaccgttggctggttatgaaccgttcataacgggcgttaataaccataccctgttagactaagcatggtccacccgcgaatcctctacagagatggccaagcgctggggtcgtggctgcgtcctctaggccaggccttggtgggcagctgttgacatgtccagaaccccaggaagtgctgaaggtacctgcagttcaggccccatggaagcccagacctccttcacccttcggggacactgaaattggccaaatgtttaggccatgaggatggctgctgagtaagcccataatccctacatcggacacaaccttgtgcaaaggaccttctcaccacagatcagccagaccatcttcctccttccaagtcatcaaagagttccaagctggtcacctgtcccttgatgttcccaggaaaccaggaaagaggacccctgcattttatcttcccatccagagtggcaggatctctgcctgggaaacaggcttcattcagcacagctgtggtagcattaacaaagcaaagtgggcacatgtagaagttgaagctaaaacattcaagaactccagtctgtttctgtggatgttaagggggtgaagataaaacaatggaggtgatgaggaggaataacttgaagacagtttaaagccacagtgatacaaagaatgaagagaaggaaggtgctggattttactaagaaaacagactgagttcaggagtctcaccagtagaactttatagtattgcgtttcgattacatgtgtgtgaattttaaaaactgattaccctccagtaaaaatgtggaaccaatttgcatttggattaaaacattaggtttggggacaaaagtggaccccatgctgcctgagatgaagagagagagcaggatggcagaggaatcaccagctcaagaaaccccaagacttggacagtcttccagcagaagaggccagggtctctcagtgtactactccaaacaggcctctcctagagatgtagtctgggaaggtccaaaacccaccagacaggcacatccagtggggaaaagacttcccattccagtgtggcctgcatccctcacctctgcttcccagtcttctgctgacctcagaggagcagggtggccattgctgatctgggttagggagatgccagaaacacacccaggtttgaaccacaggttagtggtacaaagtcacagtccttgtgccttcagaaaacccagaggccccaaatacgagtgggaagagagttgggaaaaactgaaccagactcttccaatggccattaaagagaaaattcagcaacgcttgcctttgtctttgaccctgagaagttaagggacacagattgtggcgccgtgatggaacatggagggaaggcatggtgtgcttcctgcagagatgcctctggagtccctgtggccacgggatctcactggccccctcttcaggcaccttgatggggctcagtggggccaggccgaagggtggaagtagaaaagcatcaacaggctgtccagatcaattggcaccatccaaggccctgctgcacccacacatggaggtcaccagctcagccccaggggttctttcacacacaagctccttccctaaggagtcctgtggggttccacactcagtgtgctgcccaagtcagagatttaccacagatctgtctccccctcaacctggactcaagttactgtggtgagaaacctcactgtccatggttaactgaagaaatccctccttcagaaagaacttgagtagtagatgaggtggttagacaggatctttttccctcaagctgtttggacgccacagccaggaccaactctgacagctgcgagagagagagcccctccaatgtggaacctcctacacagccccccttttgggtccctggatatgagcccccagcaggaccaccactctagggggaagtctccctcccatccctcagatccccacattgttcctcctgtaggagaaaagtcagccctgcccctggagcttctccaagatggcactggactcgccgttatcttgaggagccaggagctgaaatggctccggcttagcaacccagtatggccaaagtggaaaggttctctgtcctttgcagtcaccaaaaaaaaaaaaaaaaaaaaaaaaaaaaaaaaaaaaaaaaaaaaaaaaaaaggggggggggtaaaattttccccgggggggcccacacgttaaatgcacgctaccccatgcttttagtagtaagaaagggggccgccccattgaatgggggcgcggcgattataataaaagcaagggcaccgggcgcgcggcgtgtttaacaaacggctggcggagtggaaaaacactgcgatgccgtgggacatcttggtggagagggaacccatattatgctgtggggggggggggcacatatatgtggggcacaaaatcatcctatcagaagaaatatttatagcgccttgagggggaaaatatataaatttttcagaggtgtttaattagggtggtttacacaaacgcggtataattgacgtggagatggttgaagaaaaatttgtgggtactcagggggagtatgtagttttgatgaaaaaaatttttatattaccaggagggactttttataatataatagaggtg

SEQ ID NO: 29552 - DNA, 364 bp, Homo sapiens
tgacagagcgagactctgtctcaacaacaacaacaacaataaataaataaataaattttagaatgaaataatttcttatactatttctcttaccagcttaaagtgccagagcctaaaaatagacaaagttaaatgacatttaaaatgatcaataaatactaaaaaaaaataaaaataaaaaaaaaatgaaaaacggtgcccaccacaaactatagacacaaagagtgttcagttatcaccagtgtagacagggcaatttaaagagcacatttcatagtgttcctacccaagattcagtttgcttacagcaggtgagaacacaagtaggataaacccctcagaatgccatcatctcagtaggttc

SEQ ID NO: 29553 - DNA, 642 bp, Homo sapiens
tgtgttagcttagtggttatggtattactgcagggacatggatcacttagggagagagcgtttcaggcttgggtcagtcttaaagcagatctcatgtggagggtttctgctaacctgcatctcttacaacacagtactagtcagtatgctgtagtattaatcagtaggtcaagttcagtgaagtaaaggagaattgaattcttgaagttcacatttaggcaaaaatttggcgttttaggaggtgagtataagacatgatctttatagaaaacgctgatgataaaaacagcgctctctgttaggtgcttttatgcttgactccattgtcatcttttcttaagaaactaagctcaggactgggtgcaatggctcatgtctgtaatcccagcactttgggaggctgaggctataggatcagttgagctcaggagttcaagatcagcctgggcaacatagctagacctcgtctctactaaaaaacaaacaaacaaaaaacaaaaaaaaacccccaaaaaaaccaacaaaccagcttggcatggtggtgcgtgcctgtggtcccagctgctcaagaagctgaagcgggaggatagcttgagcccaggagatcaaggctgcacttagctatgatcgcaccatcgcact

SEQ ID NO: 29554 - DNA, 389 bp, Homo sapiens
gtctcactatgttgtccaggcgggtctcaaacacccagcctggagcaatcctcctgccttagcttcctgaagtgaggggattacaggcttgagctactgtgctggacccaatttcaaacacttaaaaaaatcaagtactaccatgtcaaaagaaaacaatttaacaataaaacaaaacaatgtgaggaactacagaaaacaaagctgagtaaacaggccaaggtccttaccttcatgaattttttttttttaaatgtggtaaaatatacgtaaaatttaccatcttaaccctttttgggtatacaattcagtggcattaagtacattcacattattgtgtaaccatcatcactatccatctccagaactttcccatcatcacaaactct

SEQ ID NO: 29555 - DNA, 3193 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgagatggtgccttgctgtgttgcccaggctggtctaaaactcctgggatcaagtgatcctcccaccttggcctcccaaagtattgtgattacagggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29556 - DNA, 439 bp, Homo sapiens
accactgcccggacccagccctggcccaatggggctcgcacctccaaagcccacgtccacacgttccgagcccgccgtcccatcgcaaacatccgggggccgccactgcgcctaacgaccgcccatctctgacgcctcgggtcggcgtttgatttttaacccaagaaaagagtaaaagtcaagcggaaatcaacgcagaagcggtgctgcagcctctgagcttcctgacggccgtgtccagagccgggctcctcctcccgcggcagccgccgggctcacttcagtgcgctcagcttctcgcggggacaagcgtctgggcggggacggcccgaggcgggggtgtggcgaggctggagaacgctgaaagctggtgggcttgggaagacaaacgacgctctgaaatttggctcccaggtaatacgttccggcacttcgcggc

SEQ ID NO: 29557 - DNA, 3280 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29558 - DNA, 3384 bp, Homo sapiens
ctgcggcgggcggcgaagggggacctggttgcggccgtgggagggggcgcccgccggcgtccaggccgggctgcggggctgcgtgggcgcgggcggccgggccggggcccgcggggtggggcgggcgccgagtctcggcctctggggtcgggagtctccatgggcgtttccggggtctccgcagatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29559 - DNA, 3316 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgaagctaacaaggaaaatgtgttccatgggaccaaagatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29560 - DNA, 3406 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttctgtgagtgaccacggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29561 - DNA, 3100 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29562 - DNA, 3040 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29563 - DNA, 3289 bp, Homo sapiens
accactgcccggacccagccctggcccaatggggctcgcacctccaaagcccacgtccacacgttccgagcccgccgtcccatcgcaaacatccgggggccgccactgcgcctaacgaccgcccatctctgacgcctcgggtcggcgtttgatttttaacccaagaaaagagtaaaagtcaagcggaaatcaacgcagaagcggtgctgcagcctctgagcttcctgacggccgtgtccagagccgggctcctcctcccgcggcagccgccgggctcacttcagtgcgctcagcttctcgcggggacaagcgtctgggcggggacggcccgaggcgggggtgtggcgaggctggagaacgctgaaagctggtgggcttgggaagacaaacgacgctctgaaatttggctcccaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29564 - DNA, 2729 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggaccccacaggccctgggggatgcaccctccacgtccgtcagcctgacgacaggtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29565 - DNA, 2462 bp, Homo sapiens
taggatccccctgtagctgggcacagagcgagactccatctctaaaaataacaaaccagaaaatgtgagcctcgccttttttcagggatacaactcctcgccatcacagtccatcacaacctgggtggcgttagctggatgtggccccgccccgatttccatgagacccctcctgaacaatgtttccagaaagagttgagctcctgagcctggtgctgacgaattgtgttggagacagccctcagcgctgagtgcgtgtaacgagtgtcctctctccacaggtgcggtctgcctgcagcctttctgccacctgtactggggctgcacccggaccggctgctacggctgcctggccccgttttgtggtaatactggctcttcaggccccagttgctttgacctttgcatgttctcttggtgaacttgagggcaggggatggtggggtccatagcctgatgtttatagggatgaggccactgttggtcatcaaatgatacctattcctggctggactgcagaggtgtgtcaaattcgtgttagctcaaaatcaagccttaacagaattattaggggagatactcccaggacagaatccttgcagcggggttctgctgttacgataccaagaccaggtgctggggagactcggagagctgatctttttaaggagggagtggaatggaaatcatttctgcttgtcctctgtttaaaattgagttttatcattgaacttcttattctttctagaatctgtaatgaaaagaaatatgtttatcctcagtgtcgggcagacagtgctttcctgcgacatcattataaacaggtaacattgccccttcatctcggcagagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29566 - DNA, 2025 bp, Homo sapiens
  misc_feature (40)..(40): n is a, c, g, or t
agtgatgctgaggtgatctagaggatcccgggagcagganctgttggtcatcaaatgatacctattcctggctggactgcagaggtgtgtcaaattcgtgttagctcaaaatcaagccttaacagaattattaggggagatactcccaggacagaatccttgcagcggggttctgctgttacgataccaagaccaggtgctggggagactcggagagctgatctttttaaggagggagtggaatggaaatcatttctgcttgtcctctgtttaaaattgagttttatcattgaacttcttattctttctagaatctgtaatgaaaagaaatatgtttatcctcagtgtcgggcagacagtgctttcctgcgacatcattataaacaggtaacattgccccttcatctcggcagagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29567 - DNA, 1330 bp, Homo sapiens
ttcctctcctcccacctcagcttccttcattgctcttattttataccctatcctgcaggaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29568 - DNA, 2397 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29569 - DNA, 1683 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29570 - DNA, 1190 bp, Homo sapiens
accactgcccggacccagccctggcccaatggggctcgcacctccaaagcccacgtccacacgttccgagcccgccgtcccatcgcaaacatccgggggccgccactgcgcctaacgaccgcccatctctgacgcctcgggtcggcgtttgatttttaacccaagaaaagagtaaaagtcaagcggaaatcaacgcagaagcggtgctgcagcctctgagcttcctgacggccgtgtccagagccgggctcctcctcccgcggcagccgccgggctcacttcagtgcgctcagcttctcgcggggacaagcgtctgggcggggacggcccgaggcgggggtgtggcgaggctggagaacgctgaaagctggtgggcttgggaagacaaacgacgctctgaaatttggctcccaggttgcgacctttccttccccagcaataaactggtctctggagatcactgtagaattgtagtggatgaaaaatcaggtcaggtgacactggaagataccagacggagtctcgctctgtggctcaggctgaagtgctgttgcagtgagccgataccgcgtcactgcactccagcctgggcgacagaccaggtctcaaaaaaaaaagaaaagaaaacatgccagatttgaatagccacctgaatgctgaagttttaccagctctcttgggctgtgtacccttcatcgtatcttccaggttccttaaaacctacccttgggcacagctgggatgtgcactggctcttcacagctagatccagcatgcactgactctccccgtgcagggacagccccagaggaatagaggtggcgttccggccgctccagcgtggcccacagcgtttcaagtgcagcaagcacagacaggacgcagggttactagtattttggattgactgcagattttgaactgtctgcctagatgaactataccatgtccctagggccaagtcccatgtgcattttgtggctactagaccctcttcagaaatcaaacacaaaatagctctggcctgtaaagaaaacaaacttcaccagtaaaattgtttcctgttcctatccaccaatgtgcatagcacagtgtgtagtctgggtaatacggtttgcataattttttgataatgttctacttaaaaagggcagcgtatttatatattacttatgtaattaaaaaaaaaa

SEQ ID NO: 29571 - DNA, 1872 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattaggtaaatcatgcccctggctcagagcagagtgtgtgagccagaggagcatcacaaccgtgaccgagagctcactactgggtggacagcatgggtcctgagatctagttctgccctgagcagccaagctcttaaatggcttgagcttgttttctgatattggatagtattagcacctcccctgagaggcgtggcagggactgggtgaacacttagcggggtagccagggggtagccagcagagcgtcagccgcaggcgactgctgtagacatttgcaccctcggctgacacccttccctttgcttcgactcgtcatgggtgtggcatctctggctgtgacagagggacatcattccatgttattttttcccacatgagcacatgtattctttgtagttgatctagcgactataaagtcctatagtataaattgcaatgtttatcatttgtcaggacgttattacagaagaggcaccatcaccaggccaagacaatcccagcctcagagaccttatttatctgctgacatgttgaggtttcctaatgcacaaga

SEQ ID NO: 29572 - DNA, 829 bp, Homo sapiens
accactgcccggacccagccctggcccaatggggctcgcacctccaaagcccacgtccacacgttccgagcccgccgtcccatcgcaaacatccgggggccgccactgcgcctaacgaccgcccatctctgacgcctcgggtcggcgtttgatttttaacccaagaaaagagtaaaagtcaagcggaaatcaacgcagaagcggtgctgcagcctctgagcttcctgacggccgtgtccagagccgggctcctcctcccgcggcagccgccgggctcacttcagtgcgctcagcttctcgcggggacaagcgtctgggcggggacggcccgaggcgggggtgtggcgaggctggagaacgctgaaagctggtgggcttgggaagacaaacgacgctctgaaatttggctcccaggttgcgacctttccttccccagcaataaactggtctctggagatcactgtagaattgtagtggatgaaaaatcaggtcaggtgacactggaagataccagacggagtctcgctctgtggctcaggctgaagtgctgttggtgcgatctcggctcactgcaacctccgccacccgggttcaagcgattctcctgcctcagcctcccgagtagctgggattacagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgataccacggtgcgtatagaagt

SEQ ID NO: 29573 - DNA, 290 bp, Homo sapiens
ggctaagcctggtcacagacatctccgcatttgtttctctgcaaatgggctccttgcccccagctccaccccacgtagagataggcacaaatagagttaagatgtgagttgagtgagcacacactcctcgtaagccacttgtcattcctaaactacgacatctcaggctgccagctgcactgggctccagtcagtgacaccttacaggcatggttctctcctgagctggatggatcagcacctatcttgtttgattcctctcacagggtctgggggtggtggcatctccc

SEQ ID NO: 29574 - DNA, 476 bp, Homo sapiens
tagagatggggttttaccatgttggccaggctggtctcgaactcctgacctcaagtgatccgcccgcctcggcctcccaaagtgctagattacagacattagccactgtgcgtggccagatgtttgcacttctgtttcaaaatttttaaagggataaagaagtttacctttgggggttagtttctttgatattgtgagaagcacacacactctttctcaggtagctctttctgtgtatggtttccgaatgcgtttatttgaatgcctttctgatgctctgttgtgtaatttatttgattgcctctccaatgctctcttgtgtaatttggccattttctccctgcaggaaattcaatcatatctgtgaacagacaaggttcaaaaactaagcatccagaggccctgagcagctttcagcactggaggtgaagagagcgtgtttttaaaatacagagacaagcacgtcaaggtgtttt

SEQ ID NO: 29575 - DNA, 573 bp, Homo sapiens
caccagcacctgggcacgtgagggcagtccctccaccagcacccgggcacgtgagggcggtccgcccagacccctccttccgcagcactgcgcacgcgagctcccagcagtgtgagctgtgtctgcctgccatgtctcactgccggtgaatggcgctgtgtcctttcaattctagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattaggtaaatcatgcccctggctcagagcagagtgtgtgagccagaggagcatcacaaccgtgaccgagagctcactactgggtggacagcatgggtcctgagatctagttctgccctgagcagccaagctcttaaatggcttgagcttgttttctgatattggatagtattagcacctcccctgagaggcgtggcagggactgggtgaacacttagcggggtagccagggggtagcca

SEQ ID NO: 29576 - DNA, 442 bp, Homo sapiens
agcggcccgaggaaggcaagcagtcgccgccgccgcagccctggggacggctcctgcgtctgggcgcggaggagggcgagccgcacgtcctcctgaggaagcgggagtggaccatcgggcggagacgaggtgcggggctgaggccggggccgggggccggggccgggcagagccaccgggttgcgggcaggccacacgggcggcggtgcagtgtgcgctccagatttttccgtggagtgaaatgtcatgtaagaactggtatttattcggtgttctgcccaccgattcttgcgcatgattcacgcacatcatttagccttcgttacaactgtataagttagttgtgttcatatactctccagaatgcaatattgtcacgttcgttgccgtacagagtatcttttctgactgtaatggaacgaaattaaaaataatagaagga

SEQ ID NO: 29577 - DNA, 421 bp, Homo sapiens
ccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctc

SEQ ID NO: 29578 - DNA, 2669 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggaccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29579 - DNA, 3226 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttagcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccacggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctccgctctcgtgttgggctcgtgtctg

SEQ ID NO: 29580 - DNA, 2861 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgaagctaacaaggaaaatgtgttccatgggaccaaagatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaatggtatagatgattgacgaaaggattgctcgttaaaaaagacgtcatgtcaaatgtaactcgagtggcgcaatatgctgcacgggatcgggccacggtgacgcacaagggccgtgtaccccacggtgacaccagggcctgtcacgccgggacaatcttaacccggggcatctttacccgaggccccaaagcata

SEQ ID NO: 29581 - DNA, 1001 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagacggagtctcgctctgtggctcaggctgaagtgctgttgcagtgagccgataccgcgtcactgcactccagcctgggcgacagaccaggtctcaaaaaaaaaagaaaagaaaacatgccagatttgaatagccacctgaatgctgaagttttaccagctctcttgggctgtgtacccttcatcgtatcttccaggttccttaaaacctacccttgggcacagctgggatgtgcactggctcttcacagctagatccagcatgcactgactctccccgtgcagggacagccccagaggaatagaggtggcgttccggccgctccagcgtggcccacagcgtttcaagtgcagcaagcacagacaggacgcagggttactagtattttggattgactgcagattttgaactgtctgcctagatgaactataccatgtccctagggccaagtcccatgtgcattttgtggctactagaccctcttcagaaatcaaacacaaaatagctctggcctgtaaagaaaacaaacttcaccagtaaaattgtttcctgttcctatccaccaatgtgcatagcacagtgtgtagtctgggtaatacggtttgcataattttttgataatgttctacttaaaaagggcagcgtatttatatattacttatgtaattaaaaaaaaaa

SEQ ID NO: 29582 - DNA, 895 bp, Homo sapiens
cgcggatcggctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtggtgaggtcacatctcatgaggtcttggtgctggttgcatggtttttgttcactactctttacctgtgttgttacagaggcagataagcgactgaggactggcatgaggttctcagtagtgagatttctgtaggagtcaatattgagtgtgttgttcccttcacttcccaagagaagtgaagatcagggactctagtaccattgtgtattttgcagtttca

SEQ ID NO: 29583 - DNA, 777 bp, Homo sapiens
accatcacctccattagccactttaatggacagctgccatcctgggcagttttgagtgctaagaactggaaatctacccaaagcagtcaatttgctgccatgggaggcagtggggcagggggaggggaggagggtgaaagggggaagatggatacagagctgcagggaatatagagctggtcagggtagccacctggagattattttgaaacatctgattcctgcaatgcatgatgacacatgcccataatcacttagcacctactcagcttttttctttcttcaggcatcttattttaccagatacatgatgccaagcattcatttggtgagacagggttattcaactgggaagccaaagcactgggatagtattaggcagatccccaaatgtctttctatgagcaagcatccctaatatgcagtttgggagagacatttattgttccagtggcctaaatagattggttatttattgaaaaaaaaaaaactttttaagacctgttgaggttatagtttacaccagatctggtgctcataatcaatcctgttactctataattccagaatgaaggagaaatgctgagccttgcccttgcatttcctaccactatcccaaggctgtaactgtaacattcacatagaattttaagcaatacctgcttatatctcaaacattttaaatcttccaagttgattcaagcagcaagaaatagaaataataaataattgattctcatgagatggtagaccagtatgccctagcacctaaacttc

SEQ ID NO: 29584 - DNA, 424 bp, Homo sapiens
ccttcccccgcccatcccccgttgatccaaccacggccctctctctctaggtgagggcgtgtggctgaagcctgttcctgcttgggggttggccacacagcatcccaactccaggtccagagccgagcctgacagccctcctccactgcctcctggagctgccggagagaggtccgggtccgttctccccaattcacagacatgaagactgaggccgtggttccagtggctgctcggtggtggggctggagcttggcagcatcctgcagccctctggactcccggctctcgagtgccgcgttctacctgctgtgttctaaatggacatgccatccccacagctgtgtcaataaagcagccatttacagagcgggcgccggatcccgtgacaggttgaaaacttacactggtcttcatggcctca

SEQ ID NO: 29585 - DNA, 782 bp, Homo sapiens
tttcaaactaccgtaggctctatgacaccccccacaaaaaaaaaatttcagtgagggcgtgtggctgaagcctgttcctgcttgggggttggccacacagcatcccaactccaggtccagagccgagcctgacagccctcctccactgcctcctggagctgccggagagaggtccgggtccgttctccccaattcacagacatgaagactgaggccgtggttccagtggctgctcggtggtggggctggagcttggcagcatcctgcagccctctggactcccggctctcgagtgccgcgttctacctgctgtgttctaaatggacatgccatccccacagctgtgtcaataaagcagccatttacagagcgggcgccggatcccgtgacaggttgaaaacagctgccgtgtgccattggcacctcctgtgtgccaagtgctggcttagtctcccctggcgttttctcatatcccattaacaacccacccagtgggtatcatcatccccatttcacaggagctgtcactgcctctctccttgatggcggggtatgaagagaagccttttgacgcagggagatgacccctccccggcctccacctacacagcagccacgtggccaccctgaacagctgccacagtgaccgacaccccctggatgtgtttgtcctcccacagcaaagcacaattaacatccccactggtaaatgatatggggccatatttcacctggacccaaatgtgggccacagaggcattaaaataaatgacggcacggtt

SEQ ID NO: 29586 - DNA, 778 bp, Homo sapiens
gttcgatagatatttattctgtacgtggatttatactcacacttgagtgagggcgtgtggctgaagcctgttcctgcttgggggttggccacacagcatcccaactccaggtccagagccgagcctgacagccctcctccactgcctcctggagctgccggagagaggtccgggtccgttctccccaattcacagacatgaagactgaggccgtggttccagtggctgctcggtggtggggctggagcttggcagcatcctgcagccctctggactcccggctctcgagtgccgcgttctacctgctgtgttctaaatggacatgccatccccacagctgtgtcaataaagcagccatttacagagcgggcgccggatcccgtgacaggttgaaaacagctgccgtgtgccattggcacctcctgtgtgccaagtgctggcttagtctcccctggcgttttctcatatcccattaacaacccacccagtgggtatcatcatccccatttcacaggagctgtcactgcctctctccttgatggcggggtatgaagagaagccttttgacgcagggagatgacccctccccggcctccacctacacagcagccacgtggccaccctgaacagctgccacagtgaccgacaccccctggatgtgtttgtcctcccacagcaaagcacaattaacatccccactggtaaatgatatggggccatatttcacctggacccaaatgtgggccacagaggcattaaaataaatgacggcacggtt

SEQ ID NO: 29587 - DNA, 483 bp, Homo sapiens
ttctcaaaagatttgggcagccagcccctctagagaaaaacatagaatcacctagaaagggtttttcataaagtacacttttcatcacccctattctgtcacctggaatattgataacactgaagggagtgtgccttatctctcaggtgtatttggatgaaatagtttgagaaccatgcaggcaagtttaagccagtgtgttaaagagaatatgacatcagatttgcattttacaatcttccttttgataacaaagggaaccttaaagggctggaggggaagggcagacggggctaggggaggagaacccttttaaaaagctactgcaggtggggtgcggtggctcacacctgtaatcccagcactttgggaggccaaggcaggcagatcacctgaggtcaggagttcaagaccagcctggccaacatagtaaaaccccatctctactaaaaatacaaaaattagctaggcatggtagcaggc

SEQ ID NO: 29588 - DNA, 630 bp, Homo sapiens
gatccacacttcaaaacagagccttcttcctcaaccctgcaggctctctgtcagtgaaggactgaacagaagcaaaataccatcagcgcctgtttctccaaatggtccttggaagactcatcccaggcaccatgaagaacacccccaccctgggtttgaatctgaatctctaactaaagtaccccagggccattctcacgtagaagttttgagagcccagacactaaggaaagctggtagtgcaggaggccaaacgtgagaatttaactggggccaatggggactttcaatgggctgaacttgcaaacagctttatagctcgtggggattgggatagattagccccattttgtgggacaatgctcaggctatccacttcaacattccagaagttgcataaggaagcccaaaaacacgttctctggattttgctaagaagacattaattcattcattcactttttttttttttttttttttggacataggttcttcttgttctgttctccaggctggattgcagtggcacaatcatagctcactgtaacttgaactcctgggctcaagcaatcctcccatctcagcctcatgaacagctgggactataggcacatgctactatacccagca

SEQ ID NO: 29589 - DNA, 597 bp, Homo sapiens
gtcctgatcgatgtgagcccccctgaggcagagaagaggggctcttacgggagcacagcccacgcctcggagccaggtggacagcaagcggccgcctgcagagctgggagtcctgccaagccccggatcgacttcgtcctcgtttgggaggaggacctgaagctagacaggcagcaggacagtgccgcccgggacagaacagacatgcacaggacctggcgggagacttttctggataatcttcgtgcggctgggctgtgtgtagaccaggtacgtggaggctgtcatgggcagggccctaggccctgcatccactcagtgacccatgaccttgccgcatgaggcctgagggcatggtgtccagagtcccagagcagatcaggccccaaagtcctgctggaccccccagccaccgtgagctcctccgtgtggctagggagctgctgtccagaggcggaggtaaacattgatccctcctgcacactcagctctctcatggaagtcggagccctcagggtcacctgaaaactctgacactacctttgccattcacctgtcccgtctccaacattaaagcttttgggtaggcgtgtcatt

SEQ ID NO: 29590 - DNA, 374 bp, Homo sapiens
cgttaatctcaaactgacctgtcttccctctgtctcaatttttcttatccctcttataccttttattctttaatgtaaacatatattatatatttatgcaatatattcactatatatttatgcaaatatatagtctcttttattaaacggcaaaccctttatgcatagagatggcaatttatcttttcatagtctataaaatctaacatagtgctttgcatgctgttggtatgtagtatatttttgttgaattaacaaattgataaaaaggtgagaatttatttatcagaaagttttgcatttaccaggaaaattttataagactttttaaagtgcttgctttacatcaggttgagatcaatgctcctagagaa

SEQ ID NO: 29591 - DNA, 477 bp, Homo sapiens
tatctctccccttttgctgactcctttttcgtattcagctcacttgcactcaggtgattaaaaagctttattgctcacacaaagcctgtttggtggtctcttcacacagatgcgggtaacaccaataggcagtaggtagacatgagcacgggggaattaaagggtcaaagatttgaccaaaatattggttgggggaaaatgaggagagtgaaaatcacctggtgaccactgaacaggtcccagagactaaaactcctaatctgaggaatttagaagggaagaaagaccacctggtgaccatcaaagaggccatacagaggcaaaactccttatctgggagaaaattagaagtaattagacttccctgcggggcatggtggctcacacttgtaatcccagcactgtgggaggctgaggcaggcagatcacctgaggtcagagtttgagaccagcctggccaacatggtgaaaccccgt

SEQ ID NO: 29592 - DNA, 286 bp, Homo sapiens
  misc_feature (254)..(254): n is a, c, g, or t
  misc_feature (267)..(267): n is a, c, g, or t
  misc_feature (283)..(283): n is a, c, g, or t
ggtatcactcattcaatactttcttacataaagacttattgattagtggggacacagtttgctggacacttataagtgtctgggttataaagataaataagagagatttcttttttttttttttttcgtagagatgggatctcactatgttgctcaggctggtcttgaactcctggcctcaagcaatcctcctgcctcagcctgtaggctcccaaagtgctatgattacaggtgttgagccactgcacagaagncagcaattttttntttttaacaaatcttnctt

SEQ ID NO: 29593 - DNA, 430 bp, Homo sapiens
taatgatttcagtaaggtttcttgtcaaagtggatttattgaattggaattccagcatatttatcattaagctgagaagggaaaaatgcagggctttaccagtagaatgtcttcttagtgaggtccatgggtaaaagatttttgtgtcagaagacccttttttttgttgttatggttgccttaatgtgattcagattgatatggagcaagtttcctactctccaggctactactttacgcaactttggggcaccatttattttggagtaagcgcaaataggacgcctcatgctatacacatggaacaactatctctaaactggagccaatagctctgtcaggattattaaaaggattaaagcagatcatacattatgtaaaatatctagcataaaaatgaaaattggttatttaatattatagagccttc

SEQ ID NO: 29594 - DNA, 819 bp, Homo sapiens
atagagtgcttaggagccaggatgggagcactggaggcagaatgcctaggttcaaatcctcgttctgccatttactaattgttttgtgagttttgttgagttattgaacttctgtaggtcgtatgttttctcttgtccaaagtggtgattataataatattatagaattgttttaaataaattgactaaaagtaaaattcttagaaacatgcttgcacataataagtcctcagtaagtgttaaactgctactgttggttatagatcatgagaactgagtaagtttaagaagtccagagacttctacctgataagtggtagagccagtgattaaatataggtgatctgaatctaagtcctacttgctaatttatctagttgcctttaccatattttattatatgtttatttacttattggacataaaattattagccttctaaactttgatttaaatgtggactggctgaatgcggtggctcacgcctgtaatctcaggactttggaggttgaggtgggagggaattgcttgaggccaggagttggaggctgcactaagctgtgatcgtgccactgcactccagcggtgacagagtgagaccctgtctgaaaaaataaatgtgggccagaccatagaccaagtagttatagcaaaagagagtttctaaattactcacaacagaacttccattcttaaactagtcttttgctttaatccactggtacccaatccttagcagttataaaccaaactcatgagctatgaggggaaaatgaccatgggaaacatagatttaatgcaaaataactgaaaaaaaaa

SEQ ID NO: 29595 - DNA, 600 bp, Homo sapiens
agtcagtctacaggctaggtgcacactggacagtcagggtggttgtgagctgatggagactgtaaatgaaccagaaacaggtgaagtgagcaaagatgcagtcattgtaaagcaggagaaaaataatgaatattgccttcaggatattgatgataaattgtcagaatcagcagaggatgatggtgaagatgataccaatgatgaagatgatgatgaagatagtaaccctaaaaagaatactcaggccccactagagttaatggcagaatttctgagagcagaaatggcccgagagtatcagctggcaaaaaaattatgtcagatgatcctaatctatgaaccagaaaatcctgaggccaaggagtttttcacacttattgaagaaatgttgctgatggagaaaactcagaatcatgagcaagacggtgaaaacagtgatgaagacagcagtggtgagagtaaaggagaaagcgatgaggagctgagtgacgagagctctgacgaaggtgaagatggatcatgagtgttgctgcaatacttgaagcttcatgtattttcattaatgtataccatgcaaatataaagacaagtgacatttta

SEQ ID NO: 29596 - DNA, 736 bp, Homo sapiens
agtcagtctacaggctaggtgcacactggacagtcagggtggttgtgagctgatggagactgtaaatgaaccagaaacaggtgaagtgagcaaagatgcagtcattgtaaagcaggagaaaaataatgaatattgccttcaggatattgatgataaattgtcagaatcagcagaggatgatggtgaagatgataccaatgatgaagatgatgatgaagatagtaaccctaaaaagaatactcaggccccactagagttaatggcagaagtaagttttacttgtgcatataattgaagaaactttaaaatattgaaataactaaagactgaagatttaaaatcactactgtgagaactaaaaaagtagatctcatggaggcagaacatagaatggtggttaccagaagctggacgggaagaagggagataaagagaagtccattaaggggcacaaaaatacagttagatggaaggaataaattctagtattcagtagtacagtagggaaattatagttaacagtagtttattgtatactttagccagaagagaaaaattgtaatattcccagcacaaagaaaagataagtgtttaagatgatggataatccaattgccttgatttgatcatcacacattgtatacaagtatcaaacatgtacccccaaaatgtatacaatattatatatcaataaaaaataaacatttttaaaaattaataaaaagatccttgtcca

SEQ ID NO: 29597 - DNA, 394 bp, Homo sapiens
tccccaggacatggtggagatttagacaacccagggcagaaaatcctctaggaaaggaagtctgaactacaccgctggctttctgaaaggacaggatttgaggagctgggatggtagtaggggagagggcagctgggtggggtttcttccaggaaacaatgtggatgcaagatgcagtcctcgtccctggcctgcccttaccgctttagtatttcagatgagtcagctctcactctgccacctgctttctgtaactctgcagcaggccagcagcctccagtccaccctctcctcctcccagggctctggggtgaagccctccccaggaactccctggctcccagtacccatgggagaagctcttttcaactgacatgatttattttaacaataa

SEQ ID NO: 29598 - DNA, 348 bp, Homo sapiens
ccgtccttggaatcctaagaaaattttccagccgtattacccttctatgaagcccacctgtcaaccaacaagcacccactcgatcagagcttccccaggctttttggtgtctcctccttgcatgggaattgacttccaaggaccaccagacactgaggaagtattttaacatataaagcaaaagcaacaatagggcagctggagaaaggaaattagaagtaacagagccaatgcagtgattagaaaaacactcaaaaaatggtaataaatgtgttcaatgggtcaagagaacatatttccatctatttaaataaaaacaggaatcaataaaagtgaacatacaaaaaa

SEQ ID NO: 29599 - DNA, 750 bp, Homo sapiens
tggtgcattgtaagtattcagtatataacttgttgaataaatggatcgggtttagcattttcccccattggacctggattgacctggaaattggtggactgaacctgcaagtagagattaaaggacctaacaactgtagagtggctggtgaaggtagatataagtgcagtaagggagggagtcgttgatgttgttttggttcgtagtgcagaataaagctacttatggaaatatacgactcctactcttagtttctgctttgatgtggttactgctgttgtttagcgtaagcatataaacaaatcactggcttagtgggttaatttttcttctcttttgttaaacagctgagtttttgctgttttcaaagttagccaaaaattccattttcatgtttaaatgatttagaaaaatcatttttctttaaaaaataacagtacataaaaagaaaacattctcggctgggcgcggtggctcacgcctgtaacccagcactttgggaggctgagacaggcagttcacctgaggtcaggagtttgagaccagcctgaccaacatggagaaactccgtctctactaaaaacacaaaaattttagccgggcgttgtgccacgttcctgtaatcccagctactcgggaggctgaggcaggagaatcgcttgaacccgggaggcagaggttgcagtgagccgagatcgtgtcattgcactccagcctgggcaacaagagcgaaactccatctcaaaaaat

SEQ ID NO: 29600 - DNA, 426 bp, Homo sapiens
gtctaatcaaagttgagtaaagcatagaaaaataaaagagagtgacttaaaatgtgctgtttgaacatgtctagtacgatgccagattttgtttaaaaacttttagtttctttaaaactccccttccccttcccaatagcatcattttctctttagggattcatgtttccagagaagttgacttcactctcccttcagagatgatgtaactaatgtaggctgtccaatcagtgtatttcatccctttgcacttaatgattagtcagggtaggcactgatcctgaagtagctcagctgaataattttcaggacttttgcagagaatgctgatcttctctttcttgctagacaagaggaagatgccgacagccattttagaaccataagagaagccagtcttagaatggtgcagagaccaaggtagcc

SEQ ID NO: 29601 - DNA, 235 bp, Homo sapiens
tgatggtcattttaggttaataaaagctctgtttttagattgataattctaagggtttatcatcaaggtgtatgagaaggtgagggagcccctgtgtgtagcgcagcaactctggccttctggacagtaggtaggcatgtgatcactgttgtcactaaacctgggaaatgattcctgggtcagggttcattaattgccaaatgattaaagtaataaagctgacactggaaactta

SEQ ID NO: 29602 - DNA, 1563 bp, Homo sapiens
  misc_feature (73)..(74): n is a, c, g, or t
atgcatgggggccaggggccgctgctcctcctgctgctgctggctgtctgcctgggtgggacacaaaggaatnnccggaaccaggaggagcgcctgctcgcagacctgatgcaaaactacgaccccaacctgcggcccgcggaacgagactcggatgtggtcaatgtcagcctgaagctaaccctcaccaacctcatctccctgaacgagcgagaggaagccctcaccaccaatgtctggatagagatgcagtggtgcgactatcgcctgcgctgggatccgcgagactacgaaggcctgtgggtgctgagggtgccgtccaccatggtgtggcggccggatatcgtgctggagaacaacgtggacggtgtcttcgaggtggccctctactgcaatgtgctcgtgtcccctgacggctgtatctactggctgccgcctgccatcttccgttccgcctgctctatctcagtcacctacttccccttcgactggcagaactgctcccttatcttccagtcccagacttacagcaccaatgagattgatctgcagctgagtcaggaagatggccagaccatcgagtggattttcattgaccctgaggccttcacagagaatggggagtgggccatccagcaccgaccagccaagatgctcctggacccagcggcgccagcccaggaagcaggccaccagaaggtggtgttctacctgctcatccagcgcaagcccctcttctacgtcatcaacatcatcgccccctgtgtgctcatctcctctgtcgccatcctcatccacttccttcctgccaaggctgggggccagaagtgtaccgtcgccatcaacgtgctcctggcccagactgtcttcctcttccttgtggccaagaaggtgcctgaaacctcccaggcggtgccactcatcagcaagtacctgaccttcctcctggtggtgaccatcctcattgtcgtgaatgctgtggttgtgctcaatgtctccttgcggtctccacacacacactccatggcccgaggggtccgcaaggtgttcctgaggctcttgccccagctgctgaggatgcacgttcgcccgctggccccggcagctgtgcaggacacccagtcccggctacagaatggctcctcgggatggtcgatcacaactggggaggaggtggccctctgcctgcctcgcagtgaactcctcttccagcagtggcagcggcaagggctggtggcggcagcgctggagaagctagagaaaggcccggagttagggctgagccagttctgtggcagcctgaagcaggctgccccagccatccaggcctgtgtggaagcctgcaacctcattgcctgtgcccggcaccagcagagtcactttgacaatgggaatgaggagtggttcctggtgggccgagtgctggaccgcgtctgcttcctggccatgctctcgctcttcatctgtggcacagctggcatcttcctcatggcccactacaaccgggtgccggccctgccattccctggagatccacgcccctacctgccctcaccagactga

SEQ ID NO: 29603 - DNA, 405 bp, Homo sapiens
acagagatttactaatatttcagaagtattatactgttttcagttttcaagaggactgttataaggattgtttttacataatcatattgaaaaagctacctgtgggctgggcatggtggctcacacttgtaatctcagtgttttggaaagccgaggcaggagaatcgcttgaggacagaaatttgagacaagcctaggcaacaaagccagaccccatctctacaaaaaataatttaaaaaagaaattagctggtatggtggcatgtagctgtagtcccagctacttgggaggctgaggcaagaggatcatttgagcctctgagtccgaagttgcagtgagccatgattgtgccattgcactctggcttgggctacagagtgaagccctgtctcaaaaaacaaaac

SEQ ID NO: 29604 - DNA, 1849 bp, Homo sapiens
  misc_feature (1296)..(1296): n is a, c, g, or t
aaaaaatgatgaatatataaccagaaggagcccaggtactataaaagctaagtaacgaggaaacaaaaaaatgatgagtatataaccagaaggaacactcagtttgattcccatatcaggaagttcttgggttcagtgcaagacttgaaacctgacatggtttcattagattgtagaaaacgcttttttttttttttctggacaacagatggaaccatgttgtcggttgttcaaagatggacaggagacagaaatctatcaacctgaagtcagctccaactgcagctgtctgttctcctgaggactgtgctagtggtccacagaggtcaccttgcttatcacatgatattttcttgatgttagttgaagcacatcaccttaggtgacacatgagggccaaaggcctctttctcagggatgtatgtgaaagtgtggtgggttggggaccagctaaggaaaaaaagacatgaaggagaatgcaagcatcttacagtcatcattcagtaagaaatctttatgactggacaaaggaaaacataaacgccctttaacctagaatgcaaatttctagtgatttttacttttttagtgtatcagaagtcactgagcaaggtaagtaccagcacttacagagacggagtcataaaggctgctctctaaaagtagaggatgtgcaaaacctgtagtaccatttaacagatttttgaccttgttaattatgtcattttgaaactggaataaatatgtaatccgaaggttgatttttctgaacaaaagtaagtcaagtcaaagttttctcagagtctactgtttgattcttgagggtattcagaattcaagattgatgtgcatttcaacatttcagtttctgcctaagtgaagcgtcacttaaagccttcgaaattacagatgtaaaatgaggttgcacgtgatgtcagtagctataattcctactctggaggtagctcgatgtgtctgaaggctgagtgagctgcggcaggatgaatgaatctttgacttcaggagatgctgttctagtctgtaaccttgtcgtgtggaatcagcccatctgatgctgaacactaacttgaaatggctggccgaatgcagagtaacacatcagagcactagaccggtggaaagaacctagattgcaagtccagtgaattatctgcatcttcattttgttaggtgtagatttacttttgttattggttgcaattgcaatattttaaaatcatgattatgcgttaactccatctatttctaaaacattggtatttgtgtcatttttantgtagcttgatttttgttttcttctttctggtacaaaaacgagtttctccctccaacccctgccatgtatatctgtatcatgtatatctgtatctacattcctgtctactatcaatgcctactatttacaaggtagttcagttcgtttcagatcaactagaatttattgagtaccctgtatgctaatccctgtaccaggggcttgggatataacagtgaataagttcctggggcttacatcagtcaatatagggttactgtctattgaacaagattatttttgggtttctatctatttggggatatgataatgcatgtatttattcctaaccatcacacaataatattatgaaacaatgttagtaggaggaaggtgagagccttcattttaactgggaggacttggttctgtctaagatgttgcttttgttatgggttagtgcctattagataacattctgtttctgtgactgattatttctttttgaccttctgagttttagtttgtccactgagttttaggtaaaaaagaaaaaaaaaaggaaaaattatc

SEQ ID NO: 29605 - DNA, 501 bp, Homo sapiens
gccacatttataatgagaatgaaaacaattaaacaataaacaaaaataccaggcccggcaaggtggctcatgcctgtaatcccagcactttgagaggctgaggtgggcggatcacctgaggtcaggagttcgagaccagcccggtcaacatagagaaaccccatctctactaaaaatacaaaaattagccaggcatggtggcaggtgcctgtagtcccagctactcaggaagctgaggcaggagaacccagtttgaggttgcttgaacctgggaggtggaggttgcagtgagccaagatcgcgccattgcactccagcctgagcaacagagggagactcttatttcaaaaagaaaaaaaaaaatactcaaaccacatggtgactcaaattttaaaaatgaacatttcaaacaaaaagaaccattcagaaattaacagaaaactatatcattaccaccagatttaaacaggttcacattttgccttatttgctcatgcctca

SEQ ID NO: 29606 - DNA, 413 bp, Homo sapiens
ccagttaaagaggggcagtgagtctctttcccatctgaatggagctgggaaagaaaaacttacacagaataagagtaatcttacgttcctgattgccttgggaacgatagcatggagggggtctccttgagatttctagagatggccaaccctcagacacagctgcatgtccttaggatcctgcaggctgagcaagtaggtgaggggtcctaagaagctagggaaaattgcacaagagggttggcttcacaggtgtacagtagtataaggcccagaagggtctttgcagctggtttaccattctgcttcactatcttgaaattctttaaacaagggggccccacattttcattaaacattgcaccctgcaggtttatgttaactggttctgatggcacaagcctggaataggc

SEQ ID NO: 29607 - DNA, 879 bp, Homo sapiens
ggccagccggaggcggggcggacgcaggagggggtgtgtctggggaggggcctggcaggtcccagaaggtggcgagtttcgcggccagaggcttacaggtccaggtggagaggccgggctggccaggcttcggcctccggcgtcgggaaatggcggcggggggcaggatggaggacttgagaaaatggaaaattaactgtaagacctggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgctttgttcttatcctaatccaaatgaggacaagtgcccaggaaattacacaaacccattgaaagttcagacggttataatccttgggaaagttattttgtggattctccatttactccttgaatgctacatccagtatcaccacagcaaaatcagaaaccgaggctataacttgatctaccgatcaacaaggcatctcaagagacttgcgttgatgatacagtcctctggcaacacagtgcttctcctcatactgtgcatgcagcactccttcccagagcctggcagattgtatcttgacctcattctggccatcttggcactggaactcatctgttccctgatatgtctcctcatttacacagtgaaaatccggagatttaataaagctaaaccagagcctgatatacttgaagaagaaaaaatctatgcttaccccagcaatattacctcggagactggattcaggtaagatttaggtgagaataaa

SEQ ID NO: 29608 - DNA, 2847 bp, Homo sapiens
ggccagccggaggcggggcggacgcaggagggggtgtgtctggggaggggcctggcaggtcccagaaggtggcgagtttcgcggccagaggcttacaggtccaggtggagaggccgggctggccaggcttcggcctccggcgtcgggaaatggcggcggggggcaggatggaggacggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgctttgttcttatcctaatccaaatgaggacaagtgcccaggaaattacacaaacccattgaaagttcagacggttataatccttgggaaagttattttgtggattctccatttactccttgaatgctacatccagtatcaccacagcaaaatcagaaaccgaggctataacttgatctaccgatcaacaaggcatctcaagagacttgcgttgatgatacagtcctctggcaacacagtgcttctcctcatactgtgcatgcagcactccttcccagagcctggcagattgtatcttgacctcattctggccatcttggcactggaactcatctgttccctgatatgtctcctcatttacacagtgaaaatccggagatttaataaagctaaaccagagcctgatatacttgaagaagaaaaaatctatgcttaccccagcaatattacctcggagactggattcagaactatttcaagcctagaagaaattgttgaaaagcaaggagacaccattgaatacctgaagcgacacaatgcgctgctgagtaagcgattgttggctctcacttcctcagacctgggctgtcagccaagtagaacgtgagaggctcacggtcatgacagcaattgcagaggaacccagagtaattgagactgactgaccacctgacaagctgccacggggaactgcagcttttgctgaatagcattttacagtgtttgttggaaacctgaatttggttctgacttctgtggctgtttaaaatatagggcttgtgggtcacttgaaaagtacctgtagaagcccggataacttgaggggaatgtctgtttgtacttttggaaattatttaactgcttggtttatcctaggatcagaggctaaacaactccatagtcaacacttttccacctgacattagaaccctgtaatgatttcattatggataggggaagtctaacaagacaatcgattttaaacagggttttaatcaaataagttcttcccacttttaagctgatgaaagaagtcattatttcttgtgaatattttttcctggagagccttatcatgtattttatatgcttatgtggtgttggatgacatcatggaccatatagcttttatagagaatttttctcaccataggactgaggtctcaccaggtgatctactatgcaaattcctacagttttctattcttaagaaataagggccgggcacggcggatcatgaggtcaggaaattgagaccatcctggctaacacggtgaaaccctgtctctactaaaaatacaaaaaaaattagccgagcatggtggcgggcacctgtagtcccagccacctgggaggctgaggcaggagaatggtgtggacccaggaggcagagcttgcagtgagccgagatcacgccactgcactccagcctgggcgacagagcgagactccgtctcaaaaaaacaaaaaagaaaaagaaaagaaataagatatgatgattgattacttggaccagtgttagaccgacctgtgttagacgaacctgtgttgcctattatattggcagcaccttccattagcaatagctgaaaaattcagagaagaatttagaactttcactttatttttgccattcttcaagaagttgctgtatatttcagtctggttataccttcaattgatcaataacttcaattataggaaaggcatcttctataattttaaattactgtaaaaaaaagataccttttaaagccttggattatacttaaaaattgtaatggaagaaatgcatattaagttatatgcagatattaaacatatctgattctgaagataaaactgaagtatttttcagagcaaatggcattatttctccatttttcctagtatgcccctttaatttgtcagtttgctgttagcactgttatatgctgccttagaaagacttttggttgaaggctgaatatgaggggaggggatatttatgactgtgttaatcttttttgatcattagctgaatattcaatatttgatatgtaaccatatagggatgtgttcgatataactatataggcaagggatatattgatttggccacatctatttgatttatggagggcaaatacctgtttcttttagatacagccattgccggggcattctaaaagttttctactaagataaagatgattgtgtatggctgggagcagttgctcatgcctgtaatcttagtactttgggaggctgaggcaggaggatcactcaaggccaggagtttgagaccagcctgggcaacaatgagacactgtctctcaaaaaaaaaaaaaaaagatcgtgtgtcacctgcacacaacattcacaaactaaagccaaattgtatttttaaaatttcctttctcccttccgtttttttttgttttttggggggtttttttgttgttgttgtttttgagacagagcgagactccgtctcaaaaaaacaaaaa

SEQ ID NO: 29609 - DNA, 2897 bp, Homo sapiens
actatgagaatcgaacccatccctgagaatccaaaattctccgtgccacctatcacaccccatccagaaaaaaaaaaaaaaaaaaaaaaaaaaaaaaccttgtcggccgggtgaaaatccggagatttaataaagctaaaccagagcctgatatacttgaagaagaaaaaatctatgcttaccccagcaatattacctcggagactggattcagaactatttcaagcctagaagaaattgttgaaaagcaaggagacaccattgaatacctgaagcgacacaatgcgctgctgagtaagcgattgttggctctcacttcctcagacctgggctgtcagccaagtagaacgtgagaggctcacggtcatgacagcaattgcagaggaacccagagtaattgagactgactgaccacctgacaagctgccacggggaactgcagcttttgctgaatagcattttacagtgtttgttggaaacctgaatttggttctgacttctgtggctgtttaaaatatagggcttgtgggtcacttgattatttaactgcttggtttatcctaggatcagaggctaaacaactccatagtcaacacttttccacctgacattagaaccctgtaatgatttcattatggataggggaagtctaacaagacaatcgattttaaacagggttttaatcaaataagttcttcccacttttaagctgatgaaagaagtcattatttcttgtgaatattttttcctggagagccttatcatgtattttatatgcttatgtggtgttggatgacatcatggaccatatagcttttatagagaatttttctcaccataggactgaggtctcaccaggtgatctactatgcaaattcctacagttttctattcttaagaaataagggccgggcacggcggatcatgaggtcaggaaattgagaccatcctggctaacacggtgaaaccctgtctctactaaaaatacaaaaaaaattagccgagcatggtggcgggcacctgtagtcccagccacctgggaggctgaggcaggagaatggtgtggacccaggaggcagagcttgcagtgagccgagatcacgccactgcactccagcctgggcgacagagcgagactccgtctcaaaaaaacaaaaaagaaaaagaaaagaaataagatatgatgattgattacttggaccagtgttagaccgacctgtgttagacgaacctgtgttgcctattatattggcagcaccttccattagcaatagctgaaaaattcagagaagaatttagaactttcactttatttttgccattcttcaagaagttgctgtatatttcagtctggttataccttcaattgatcaataacttcaattataggaaaggcatcttctataattttaaattactgtaaaaaaaagataccttttaaagccttggattatacttaaaaattgtaatggaagaaatgcatattaagttatatgcagatattaaacatatctgattctgaagataaaactgaagtatttttcagagcaaatggcattatttctccatttttcctagtatgcccctttaatttgtcagtttgctgttagcactgttatatgctgccttagaaagacttttggttgaaggctgaatatgaggggaggggatatttatgactgtgttaatcttttttgatcattagctgaatattcaatatttgatatgtaaccatatagggatgtgttcgatataactatataggcaagggatatattgatttggccacatctatttgatttatggagggcaaatacctgtttcttttagatacagccattgccggggcattctaaaagttttctactaagataaagatgattgtgtatggctgggagcagttgctcatgcctgtaatcttagtactttgggaggctgaggcaggaggatcactcaaggccaggagtttgagaccagcctgggcaacaatgagacactgtctctcaaaaaaaaaaaaaaaagatcgtgtgtcacctgcacacaacattcacaaactaaagccaaattgtatttttaaaatttcctttctcccttccgtttttttttgttttttggggggtttttttgttgttgttgtttttgagacagagtctcaccctgtcgcccaggctggagtgcaatggcgcctttctttctttctttttttttcagacggagtctcgctctgttgcccaggctggagcgcagtagcatgatctcggctcactgcaacctccgcctcccgggattaagaaattctcctgcctcagcctgctgagtagctgggattacgggcacatgccaccatgcctggctaatttttgtatttttagtacaggcggggtttcaccgtgctggccaggctggtctcaaactcctgaccttttgatccgccctccttggcctcccaaagtgttgggattacaggcatgagccactgtgcccggccttcctttctttttaataagtgtatgtatctcaaagccattgccttctctagaaatctgtttctctgttctggaagagcctataaactttgccttcagttgtttttcttttcaaaagggaacaccagtggtagatgattaactcttatttatttttaaaatttaatttggatctatagtcagtatctgagatttataggatgaactttggtttacaaggaacagtgtagttaaaaagttagggtgcctatgttcttatgtaatcatcaacatgtttgttgtataatcatcaacatttttctgaatgcaatgatgaacatttcaaacaataaatgaaaatgaaactaagtatcagaagtagcaaaacagctgatgcagtggcttacgcctgtaatcccagcacttcgggag

SEQ ID NO: 29610 - DNA, 3567 bp, Homo sapiens
ggccagccggaggcggggcggacgcaggagggggtgtgtctggggaggggcctggcaggtcccagaaggtggcgagtttcgcggccagaggcttacaggtccaggtggagaggccgggctggccaggcttcggcctccggcgtcgggaaatggcggcggggggcaggatggaggacggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgctttgttcttatcctaatccaaatgaggacaagtgcccaggaaattacacaaacccattgaaagttcagacggttataatccttgggaaagttattttgtggattctccatttactccttgaatgctacatccagtatcaccacagcaaaatcagaaaccgaggctataacttgatctaccgatcaacaaggcatctcaagagacttgcgttgatgatacagtcctctggcaacacagtgcttctcctcatactgtgcatgcagcactccttcccagagcctggcagattgtatcttgacctcattctggccatcttggcactggaactcatctgttccctgatatgtctcctcatttacacagtgaaaatccggagatttaataaagctaaaccagagcctgatatacttgaagaagaaaaaatctatgcttaccccagcaatattacctcggagactggattcagaactatttcaagcctagaagaaattgttgaaaagcaaggagacaccattgaatacctgaagcgacacaatgcgctgctgagtaagcgattgttggctctcacttcctcagacctgggctgtcagccaagtagaacgtgagaggctcacggtcatgacagcaattgcagaggaacccagagtaattgagactgactgaccacctgacaagctgccacggggaactgcagcttttgctgaatagcattttacagtgtttgttggaaacctgaatttggttctgacttctgtggctgtttaaaatatagggcttgtgggtcacttgaaaagtacctgtagaagcccggataacttgaggggaatgtctgtttgtacttttggaaattatttaactgcttggtttatcctaggatcagaggctaaacaactccatagtcaacacttttccacctgacattagaaccctgtaatgatttcattatggataggggaagtctaacaagacaatcgattttaaacagggttttaatcaaataagttcttcccacttttaagctgatgaaagaagtcattatttcttgtgaatattttttcctggagagccttatcatgtattttatatgcttatgtggtgttggatgacatcatggaccatatagcttttatagagaatttttctcaccataggactgaggtctcaccaggtgatctactatgcaaattcctacagttttctattcttaagaaataagggccgggcacggcggatcatgaggtcaggaaattgagaccatcctggctaacacggtgaaaccctgtctctactaaaaatacaaaaaaaattagccgagcatggtggcgggcacctgtagtcccagccacctgggaggctgaggcaggagaatggtgtggacccaggaggcagagcttgcagtgagccgagatcacgccactgcactccagcctgggcgacagagcgagactccgtctcaaaaaaacaaaaaagaaaaagaaaagaaataagatatgatgattgattacttggaccagtgttagaccgacctgtgttagacgaacctgtgttgcctattatattggcagcaccttccattagcaatagctgaaaaattcagagaagaatttagaactttcactttatttttgccattcttcaagaagttgctgtatatttcagtctggttataccttcaattgatcaataacttcaattataggaaaggcatcttctataattttaaattactgtaaaaaaaagataccttttaaagccttggattatacttaaaaattgtaatggaagaaatgcatattaagttatatgcagatattaaacatatctgattctgaagataaaactgaagtatttttcagagcaaatggcattatttctccatttttcctagtatgcccctttaatttgtcagtttgctgttagcactgttatatgctgccttagaaagacttttggttgaaggctgaatatgaggggaggggatatttatgactgtgttaatcttttttgatcattagctgaatattcaatatttgatatgtaaccatatagggatgtgttcgatataactatataggcaagggatatattgatttggccacatctatttgatttatggagggcaaatacctgtttcttttagatacagccattgccggggcattctaaaagttttctactaagataaagatgattgtgtatggctgggagcagttgctcatgcctgtaatcttagtactttgggaggctgaggcaggaggatcactcaaggccaggagtttgagaccagcctgggcaacaatgagacactgtctctcaaaaaaaaaaaaaaaagatcgtgtgtcacctgcacacaacattcacaaactaaagccaaattgtatttttaaaatttcctttctcccttccgtttttttttgttttttggggggtttttttgttgttgttgtttttgagacagagtctcaccctgtcgcccaggctggagtgcaatggcgcctttctttctttctttttttttcagacggagtctcgctctgttgcccaggctggagcgcagtagcatgatctcggctcactgcaacctccgcctcccgggattaagaaattctcctgcctcagcctgctgagtagctgggattacgggcacatgccaccatgcctggctaatttttgtatttttagtacaggcggggtttcaccgtgctggccaggctggtctcaaactcctgaccttttgatccgccctccttggcctcccaaagtgttgggattacaggcatgagccactgtgcccggccttcctttctttttaataagtgtatgtatctcaaagccattgccttctctagaaatctgtttctctgttctggaagagcctataaactttgccttcagttgtttttcttttcaaaagggaacaccagtggtagatgattaactcttatttatttttaaaatttaatttggatctatagtcagtatctgagatttataggatgaactttggtttacaaggaacagtgtagttaaaaagttagggtgcctatgttcttatgtaatcatcaacatgtttgttgtataatcatcaacatttttctgaatgcaatgatgaacatttcaaacaataaatgaaaatgaaactaagtatcagaagtagcaaaacagctgatgcagtggcttacgcctgtaatcccagcacttcgggag

SEQ ID NO: 29611 - DNA, 3112 bp, Homo sapiens
ggccagccggaggcggggcggacgcaggagggggtgtgtctggggaggggcctggcaggtcccagaaggtggcgagtttcgcggccagaggcttacaggtccaggtggagaggccgggctggccaggcttcggcctccggcgtcgggaaatggcggcggggggcaggatggaggacggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgctttgttcttatcctaatccaaatgaggacaagtgcccaggaaattacacaaacccattgaaagttcagacggttataatccttgggaaagttattttgtggattctccatttactccttgaatgctacatccagtatcaccacagcaaaatcagaaaccgaggctataacttgatctaccgatcaacaaggcatctcaagagacttgcgttgatgatacagtcctctggcaacacagtgcttctcctcatactgtgcatgcagcactccttcccagagcctggcagattgtatcttgacctcattctggccatcttggcactggaactcatctgttccctgatatgtctcctcatttacacagtgaaaatccggagatttaataaagctaaaccagagcctgatatacttgaagaagaaaaaatctatgcttaccccagcaatattacctcggagactggattcagaactatttcaagcctagaagaaattgttgaaaagcaaggagacaccattgaatacctgaagcgacacaatgcgctgctgagtaagcgattgttggctctcacttcctcagacctgggctgtcagccaagtagaacgtgagaggctcacggtcatgacagcaattgcagaggaacccagagtaattgagactgactgaccacctgacaagctgccacggggaactgcagcttttgctgaatagcattttacagtgtttgttggaaacctgaatttggttctgacttctgtggctgtttaaaatatagggcttgtgggtcacttgaaaagtacctgtagaagcccggataacttgaggggaatgtctgtttgtacttttggaaattatttaactgcttggtttatcctaggatcagaggctaaacaactccatagtcaacacttttccacctgacattagaaccctgtaatgatttcattatggataggggaagtctaacaagacaatcgattttaaacagggttttaatcaaataagttcttcccacttttaagctgatgaaagaagtcattatttcttgtgaatattttttcctggagagccttatcatgtattttatatgcttatgtggtgttggatgacatcatggaccatatagcttttatagagaatttttctcaccataggactgaggtctcaccaggtgatctactatgcaaattcctacagttttctattcttaagaaataagggccgggcacggcggatcatgaggtcaggaaattgagaccatcctggctaacacggtgaaaccctgtctctactaaaaatacaaaaaaaattagccgagcatggtggcgggcacctgtagtcccagccacctgggaggctgaggcaggagaatggtgtggacccaggaggcagagcttgcagtgagccgagatcacgccactgcactccagcctgggcgacagagcgagactccgtctcaaaaaaacaaaaaagaaaaagaaaagaaataagatatgatgattgattacttggaccagtgttagaccgacctgtgttagacgaacctgtgttgcctattatattggcagcaccttccattagcaatagctgaaaaattcagagaagaatttagaactttcactttatttttgccattcttcaagaagttgctgtatatttcagtctggttataccttcaattgatcaataacttcaattataggaaaggcatcttctataattttaaattactgtaaaaaaaagataccttttaaagccttggattatacttaaaaattgtaatggaagaaatgcatattaagttatatgcagatattaaacatatctgattctgaagataaaactgaagtatttttcagagcaaatggcattatttctccatttttcctagtatgcccctttaatttgtcagtttgctgttagcactgttatatgctgccttagaaagacttttggttgaaggctgaatatgaggggaggggatatttatgactgtgttaatcttttttgatcattagctgaatattcaatatttgatatgtaaccatatagggatgtgttcgatataactatataggcaagggatatattgatttggccacatctatttgatttatggagggcaaatacctgtttcttttagatacagccattgccggggcattctaaaagttttctactaagataaagatgattgtgtatggctgggagcagttgctcatgcctgtaatcttagtactttgggaggctgaggcaggaggatcactcaaactcctgaccttttgatccgccctccttggcctcccaaagtgttgggattacaggcatgagccactgtgcccggccttcctttctttttaataagtgtatgtatctcaaagccattgccttctctagaaatctgtttctctgttctggaagagcctataaactttgccttcagttgtttttcttttcaaaagggaacaccagtggtagatgattaactcttatttatttttaaaatttaatttggatctatagtcagtatctgagatttataggatgaactttggtttacaaggaacagtgtagttaaaaagttagggtgcctatgttcttatgtaatcatcaacatgtttgttgtataatcatcaacatttttctgaatgcaatgatgaacatttcaaacaataaatgaaaatgaaactaagtatcagaagtagcaaaacagctgatgcagtggcttacgcctgtaatcccagcacttcgggag

SEQ ID NO: 29612 - DNA, 855 bp, Homo sapiens
  misc_feature (3)..(3): n is a, c, g, or t
  misc_feature (7)..(7): n is a, c, g, or t
ccncgcntagcgggagatggtctgaggtgggagaagagctgaagagacctggagccgacagacgggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgaggtcagcaggcagtgccagtaattggggtggaaggaagctgggggtcttaactctgatgccttgtccctttcagggatgccttatatttccaagattcctgctagtatctctcttccatttcttttgctcttttaaaatttgtttattttgtacacacaggctcttgatctgaagcccaggctagagtgcagtggtacaatcatagctcactgtaaccttgaactcctgggctcaagcaatcctcccacctcagcctcccaagtagctaggactacaggcatgtaccaccatgccctgctaacttctaaattttttgtagagacaaggtctgggtgtgttgcccaggccggtctcgaactcttggcctcaa

SEQ ID NO: 29613 - DNA, 2302 bp, Homo sapiens
  misc_feature (3)..(3): n is a, c, g, or t
  misc_feature (7)..(7): n is a, c, g, or t
ccncgcntagcgggagatggtctgaggtgggagaagagctgaagagacctggagccgacagacgggtctgggtctgccgcccaggatggagtacaatggtgtgatcttggctctttgcaacctctgcctcctgggctcaagccttcctcccacctgaacctcccaagtagcgggactgcagggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagattgtctactatgtgctgtctgaagccccaggggagcctcccccagtccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactctta

SEQ ID NO: 29614 - DNA, 2371 bp, Homo sapiens
  misc_feature (3)..(3): n is a, c, g, or t
  misc_feature (7)..(7): n is a, c, g, or t
ccncgcntagcgggagatggtctgaggtgggagaagagctgaagagacctggagccgacagacgggtctgggtctgccgcccaggatggagtacaatggtgtgatcttggctctttgcaacctctgcctcctgggctcaagccttcctcccacctgaacctcccaagtagcgggactgcagggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgtgctgcaggtggaaggtgacctgagccttggaaagtgtcagactcttccttttaaacccctttctacagaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagattgtctactatgtgctgtctgaagccccaggggagcctcccccagtccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactctta

SEQ ID NO: 29615 - DNA, 1165 bp, Homo sapiens
cgataatccacgggcactatccgctacgacccgacagcgatccagcctcatggagacccaacggactacaagacatgctcagctgctgatagctgagcagagactcgcatatcaacgacaggggcaacaacctcaccgtgcaccttcgcaagaagcaccagttcaagtggccctcagggcatccccgttttcggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagattgtctactatgtgctgtctgaagccccaggggagcctcccccagtccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactctta

SEQ ID NO: 29616 - DNA, 2185 bp, Homo sapiens
  misc_feature (3)..(3): n is a, c, g, or t
  misc_feature (7)..(7): n is a, c, g, or t
ccncgcntagcgggagatggtctgaggtgggagaagagctgaagagacctggagccgacagacgggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagattgtctactatgtgctgtctgaagccccaggggagcctcccccagtccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactctta

SEQ ID NO: 29617 - DNA, 3052 bp, Homo sapiens
  misc_feature (3)..(3): n is a, c, g, or t
  misc_feature (7)..(7): n is a, c, g, or t
ccncgcntagcgggagatggtctgaggtgggagaagagctgaagagacctggagccgacagacgggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcggtatgtctctcaaccctccttcccagattaacacacttgtttttataccttttcaaccagttttaaaaaccttaatttgtgtcgggcgcggtggcttacgcctgtaatcccagcactttgggaggccaaggtgggcggatcatgaggtcaggagttcgagaccagcctggccaacatggtgaaaccccgtctctactaaaaatacaaaaagtagctgagcatggtggcacatgcctgtagtcccagctacttgggaggctgaggtgggagaatcacttgaacccagaaggcggaggttgtagtgagctgagatcatgccactgcactccaacctgggtgacagagcgagactccatctcaaaaataaataaataaataaataaaaaaaccttaatttgatggtggttttatgtctgccatttccatttagattcaaagaatcctaagaataatggtggagcaaagcttatttttctgttttttgaatcttgtaaggcatggtgccaaacccaataaatggtgccaaaaagtcctgcagctggaactagagctagagtctaagggttctgatccttagctccaaggccttctcataaatcctttgacactttcaccctccaacacagtcagtcagtctctgtttttctggttgggtttctatataaaactttccattttgagtaatgatctttccctcttgccttttcttctacatattccaataaagaccttttttgtcttcaactcctgtcacttggattccaggacttcttccatccctcatgtttgttccttactttgccagcctcggccatttctgtatccccctgcctgggtttgctgccctttatgctcctacctcaccaggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagattgtctactatgtgctgtctgaagccccaggggagcctcccccagtccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactctta

SEQ ID NO: 29618 - DNA, 2240 bp, Homo sapiens
  misc_feature (3)..(3): n is a, c, g, or t
  misc_feature (7)..(7): n is a, c, g, or t
ccncgcntagcgggagatggtctgaggtgggagaagagctgaagagacctggagccgacagacgggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcatgaggaaactgaggctcagagaggttaaatcacttacctgagatcacacagctaagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagattgtctactatgtgctgtctgaagccccaggggagcctcccccagtccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactctta

SEQ ID NO: 29619 - DNA, 1454 bp, Homo sapiens
  misc_feature (3)..(3): n is a, c, g, or t
  misc_feature (7)..(7): n is a, c, g, or t
ccncgcntagcgggagatggtctgaggtgggagaagagctgaagagacctggagccgacagacgggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggtagggctgcttcttaacttgtggcttctggaggaaacgctggggttcctgaagagctgggacagaaagggataggggtcctacaggggcaaggttgactgccggctggagagactcaggggtaccagttctgtcatccacgtggtgaatcagaccaatgcccaaggccagcaagagattgtctactatgtgctgtctgaagccccaggggagcctcccccagtccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactctta

SEQ ID NO: 29620 - DNA, 381 bp, Homo sapiens
agtaattagtaaatttggccatgtacatttaggaaaagcacacgtcgcaatatttgtctttttctctcagtatcttcttgaatttatttatacacagttctaatttggtcatttagtgactgattgactttgtctttataagtatcggcaaaatcttttggcctctctgttcaaatttttattatctgtagtctgagcaatgtgctttcaacctctctatcttccattccaatatgtgtacttcgccctgggttatcttcttaaacatgaagctaattgtgtcactgcatgcttgtaaaatattcagagctccttgttgcctacacataatattcaaactctggctttttcattagcttgtcccatatcacctgtggagcc

SEQ ID NO: 29621 - DNA, 221 bp, Homo sapiens
  misc_feature (20)..(20): n is a, c, g, or t
cggcacgagggttaccattntgatgttggagcggccgcaatcgttgcacttgtaaggtttttctccagtatgaacactatggtgccatgcaaggtattgcttctgatgaaagactttgccacatacatcacatttatactgtttctctcctgaatgggttacgtgatgtctccttaaacgtgagctatgattaaaggctttgccacactcattacattgga

SEQ ID NO: 29622 - DNA, 357 bp, Homo sapiens
tgtcacaaaccttacgtttgtatggtttttctccagtatgaattctcctgtgtgtttcaagttgtgatcctcaactctaaactttgttgcattcttcacatttgtaatgtttctgtacagtatgaagtctatgatgacactgaagggatgacttctgattgaaggtcttggaacactcattacacttgtaaggtttttctccagtatgaacactatggtgccatgcaaggtattgcttctgatgaaagactttgccacatacatcacatttatactgtttctctcctgaatgggttacgtgatgtctccttaaacgtgagctatgattaaaggctttgccacactcattacattgga

SEQ ID NO: 29623 - DNA, 1076 bp, Homo sapiens
agttattcttgcttaatcattttaaaattatttctggatttacctactcaccatatgagctggggtttctgacctccctcctgcacatcacgccctccttgtctgttgctttttctagctctgtttccctgcatcttgggttgaggttagcagactggctacccctttcccagagctctgttcccctttctttgcctctgaaaggaggtttgctgtccttaccgtagcggacaccgtttgttattaaataatacctctggacacatctccttgttgtaaatcaataagcaaatgcaatacagggaaagacatacggattggagagttgtacggagctttgcacaagcagagcccagaagctgttcgttcatttcacgcgaccagaaaaaattcctgatggtgctatgaccccggtgcccggttggcacttcctggttttctgtttctgctattctgttacctgcttggttagctttgcaggctcctcagagaacacagaaacagctgaaaccagggtccgagctcaggaaacctggactacagcgcagcagggtaaacctgacaaataaacgcgacggggaactccgtcccaagctgctgatctatggaatgaagcaacacctcatcaagagaagcaacctgggcaaaccaggcctggtttaactgcactttctcacgtttgatcattttctcaagagatacgtgcgtggtcctctgcaattcagaatgaaatctgaacttctggaaaaactctcctagagggggtttgaggacaagagacaagggaaatttggacacagacatacaaagaggagagaatgctatatgaagacacagagacagacagacccagagaacagatggccatgtgaccacagaggctgtgattggcattgcatagctacaagccaggaaactctgaggatttccagaaacctccagaagttagtagagaggtatggaatagattctccccatgcctgagctgccaagaaggaactaagcctgctgataccttgattttggacatctggcctcctgaactgtgagagaataaatttctgttgtgttaagcc

SEQ ID NO: 29624 - DNA, 935 bp, Homo sapiens
agttattcttgcttaatcattttaaaattatttctggatttacctactcaccatatgagctggggtttctgacctccctcctgcacatcacgccctccttgtctgttgctttttctagctctgtttccctgcatcttgggttgaggttagcagactggctacccctttcccagagctctgttcccctttctttgcctctgaaaggaggtttgctgtccttaccgtagcggacaccgtttgttattaaataatacctctggacacatctccttgttgtaaatcaataagcaaatgcaatacagggaaagacatacggattggagagttgtacggagctttgcacaagcagagcccagaagctgttcgttcatttcacgcgaccagaaaaaattcctgatggtgctatgaccccggtgcccggttggcacttcctggttttctgtttctgctattctgttacctgcttggttagctttgcaggctcctcagagaacacagaaacagctgaaaccagggtccgagctcaggaaacctggactacagcgcagcagggtaaacctgacaaataaacgcgacggggaactccgtcccaagctgctgatctgtgagtagaaagaaaatgcagcttagaaaacttgatcgctaatgaaagaatcggccaccctagctttctcagacctgggaatctgggcctggggggtggttccagcaaagaggtatcacattcccacatttcccccaactttaactggtcaaatccactgcgcgaagggcaagcccaagggacctaccactcaattttcagcgctccagctggggatgcagccttcccaacccgaaaccaatcctcgccccagaaggggaaaaataatctccccagagcaagtccgatgagagaagcatcttttattctcgacccgtcaggtgcatttccc

SEQ ID NO: 29625 - DNA, 811 bp, Homo sapiens
agccgggctcctggctacgcggcgacggctgggtgactgcgccccacagtgcgggccagggcggggcgtcccggcagggaggcgaccgtcccctgaggccctcagcccctgccgcggcagcgcctaatgaagcgcggaaaggagagcccagatggcagcgacgggggccgagagagcaggaatttgttaaaagacgatgcgaggggagagcctgctttccgagtgagggccagcgctggggagcagagacggtggcttctgtccctgccctcctcgttatgaaccaaaaataaaattctaagccctgcagccaacggatggaccctcccctccgcctgtggccttctaagttatcttgaaaaactagttcaggccttgatgggaagcggaagtcaaacatggcctcacaaacatccgcacggagaccctaagactaatagaggactctgataagaaacatttgcggtgtattcccggcttcatctgcatgataacaccttggtctccacaactccttcatgcaacccggacattcccttctactgagtccaggtctttagatgataactctcaaccagttgccaatcagaaaacctttaaatgtacctatgacccggacgcctccacttcacattttacctcctaaagagccaacctacatcttacgtattgattgatgtctcatgtctccctcaaatgtataaaaccaagatgtttcctggccaccctgggcacatgtcatcagaacctcctgaggttgtgtcaatgcacgtccttaaccttggcaaataaacttcctaaattgagacca

SEQ ID NO: 29626 - DNA, 430 bp, Homo sapiens
aaacaaatgtccagtggtaagacaagctgtacagctgctaggacagaagacacaaccctggtgacaggctggaatctatctactttgccactttctttatttgcgaactgggttagaagtctgggcgctcagcctggcctcctgacttgtttctcttcatggggcatcatacaggattttgagtttgtctttattaaaatcttagaggaagcctacctgttatctgaatcagaggtgtagtgaagaacagccctagattttcctgtgtagacttacctatgtgactttatgcagagagtgacactttgcccttctgaccctcagtgacctcgactgtaaatgagtgtcatccaccctgcctgccttgcagaatgttctcagagtctgataaattgatggaggtgaaaacatcttgcaaactgcatagaac

SEQ ID NO: 29627 - DNA, 757 bp, Homo sapiens
  misc_feature (310)..(310): n is a, c, g, or t
atcgggatggcatatttgatttttagtattagatttgatatttaatattttaaaaattaggtggcaaaggagaaactaaaaaagtaggaaaggggttcctgtgccttcagtgtgttaaaaagccagctaaaggggagtaaggggaagcaatggtgagatgccaagttgttcaccctgatatgacttgggcagggtctgaggtatcaaccccagacaacccagggcctgggacttattgcttctgttgggaaattgacagttcacactggcctttctcaggaatgttgggcactgccacttgactaattcntgtggaccgggggcaccttttattagccttcatcagcctgtttccccagctgtaaaatgctgaaagtgaaacctagcttaaatggctttcttgaggaatagaaaagaaaccacgtataaactatctggtacatagtaggtgctcagcaaatgtccattccctttctctgttgtacattcctcttttgaagttcagtgctttaccaaggcatttcctctctgctgtgacttgctttaatccaccatcctgttcaccggatgttcggttgagggagaagaatgcaaggcactgaggaaaattctggcataaaaacctttgtttacaaataacttaggaacctgctagaggaaaacttgtatgacttgagatcacattatttaactgttcatatggtatttgcattttttccagttctatttagtagagaaaagtaacttagtccataaa

SEQ ID NO: 29628 - DNA, 350 bp, Homo sapiens
aggctcagcctggagatgtgtgaggcctccgacctggagcagcacccgcccctaaagaccaggcacaaatcccagcacatggagggatccagacaaatacacaagagatgaccacagcaggagctttactgagcacagagcgaggccgcacaccactcagctcctgcccctccacctgcccttctctccccacctgcccctgccccagcacagcagatcctcagaatccaaaaagagaacctaacttccatgttttattaatggcttataatattttatcacatcttcagaaaacactatgcagaagataactgtagagcaagacatctatttagggtgagtgagtcaca

SEQ ID NO: 29629 - DNA, 561 bp, Homo sapiens
gactgagtagcttccccgccactcctctaaaatccctcctcaaaaaccccaagttaaaaaaaaaaaagatctattcttgtagattttttttgtgtgggtctatgtttcattcatctgctttcaggctggatttataacaagcagaacttttaaaacgcttcaggaaaaagaggaccttagaactgaaggagcaagattccaacatcacactgtttttgttagctgtgtgtgtgtgtttcctgtgtatccaaaagacagaggagatgaaaaagcaaaagaaaagaaacgaggaatcagactggaaagaaggtttctccaggacgtcacctgtatgaggtacacagtgtgatgacacactctgtgcttttcctacttgtgtccacgtgagtgtctggagctgcccttcaaggagagcaatagatgaatgattctgccttcccgctgagagggatgtgggtcctgcggatggtcggggtgaagcttcctctcctttctgctgacagcacttcctcattaaatgcagagatctgcaaaaagggaaaataaaaacacaagaagaaa

SEQ ID NO: 29630 - DNA, 849 bp, Homo sapiens
tgtcttttggctgtgcttaaaaatttccaacagatttgctacacatcttaggataaatatgtttcctgtgaattgtgatgatttcttacagtacatttgcaagcatgtgtatgcatctgcaggaaacatagcctggctctgtgaaggaatactgctgtgaccgcaaaactgtttctgtagaattttctccggtgtggtcatcctgccttcagaggtttctccaggacgtcacctgtatgaggtacacagtgtgatgacacactctgtgcttttcctacttgtgtccacggctcaagcctggaagaagccttaggacgtgggggaaatgtctaacgtggagtccacctgctgagcaggaccgggtgtgaaggaagaagctttgttctgattcctcatggcccagccacccctcgcctgagctgagcctggccacagggcccgcctgcaggaagggctggcccatggcttcacactgggctcaggctgcgctaagagccccgggtgaggacctccaagcccaggaagcctcagttggccaaagtgctagatgcgtgtggtctgctttcatccccgcttccctcagagcttgcattttccaaattcaagagaggctccaccttcaagaagaccggcctgtccctgttatttatgtgtccccctaccatatctccctttgttctgcagagcgggcatactggccagcagctgtctccggcatgcttgggttcacaaaagtcagcattgggtagcttcggggggaaagatctttcggagcaataatgtaggtgaggtagattttttggtctcacaaggaatatcctttgggtttaaaaaaaaaaataaaacaca

SEQ ID NO: 29631 - DNA, 430 bp, Homo sapiens
cccggttcctcgagaggtcgtcgccttgcagccctggctgatttcgaaggctaaaggcgattcttcaacacaaatggcgtcttgctctgtcacccaggctggagtgcagtggtgcgatctcggctcactgcaacctctgcccttctggttcaagcaattctccctgcctcagcctgaggtttctccaggacgtcacctgtatgaggtacacagtgtgatgacacactctgtgcttttcctacttgtgtccacgtgagtgtctggagctgcccttcaaggagagcaatagatgaatgattctgccttcccgctgagagggatgtgggtcctgcggatggtcggggtgaagcttcctctcctttctgctgacagcacttcctcattaaatgcagagatctgcaaaaagggaaaataaaaacacaagaagaaa

SEQ ID NO: 29632 - DNA, 427 bp, Homo sapiens
aagtgagggtaaaaagtctctcccttgtaaggttgttagagggctcggcaaggagatggatgtggaggggcctggggtgtggaacatagcatacacttggtggggcaagctatcagggttatttattacttaaatcattttaattgtgggtcataaaatttctgtttttccagaggtttctccaggacgtcacctgtatgaggtacacagtgtgatgacacactctgtgcttttcctacttgtgtccacgtgagtgtctggagctgcccttcaaggagagcaatagatgaatgattctgccttcccgctgagagggatgtgggtcctgcggatggtcggggtgaagcttcctctcctttctgctgacagcacttcctcattaaatgcagagatctgcaaaaagggaaaataaaaacacaagaagaaa

SEQ ID NO: 29633 - DNA, 526 bp, Homo sapiens
aagtgagggtaaaaagtctctcccttgtaaggttgttagagggctcggcaaggagatggatgtggaggggcctggggtgtggaacatagcatacacttggtggggcaagctatcagggttatttattacttaaatcattttaattgtgggtcataaaatttctgtttttccagaggtttctccaggacgtcacctgtatgaggtacacagtgtgatgacacactctgtgcttttcctacttgtgtccacgtgagtgtctggagctgcccttcaaggagagcaatagatgaatgattctgccttcccgctgagagggatgtgggtcctgcggatggtcggggtgaagcttcctctcctttctgctgacagcacttcctcattaaatgcagagattttttttttgctctttaaattgtcatccattatattcatcaacacagagagatggaacatttggcaaaattattttaagtagcactccaacctgtgatcgtaatttcaaatcaaggaatttgctgagcagctg

SEQ ID NO: 29634 - DNA, 433 bp, Homo sapiens
gactgagtagcttccccgccactcctctaaaatccctcctcaaaaaccccaagttaaaaaaaaaaaagatctattcttgtagattttttttgtgtgggtctatgtttcattcatctgctttcaggctggatttataacaagcagaacttttaaaacggtatgattttaaaataaaattaaaaaaaaaacacgctgagatctttccatagctttggcttctgggagttgaaagcgcagcttcaggaaaaagaggaccttagaactgaaggagcaagattccaacatcacactgtttttgttagctgtgtgtgtgtgtttcctgtgtatccaaaagacagaggagatgaaaaagcaaaagaaaagaaacgaggaatcagactggaaagagtatgagtttgtacttatgaaataaaacttttatctctctacacag

SEQ ID NO: 29635 - DNA, 400 bp, Homo sapiens
tcatccaggctagagtgcccaagagagaggaacaacatgtgtgatagctcagaggagagacagaaaggggagtggctaagagcatggaagagtacgaggttctagatccttctctgggtgtcagtttccactccttagccgtgagccactctcttgagcaagtctggcagatgggaagctggaaggtcaaggctggggcatccatcctacccctgcctggatatggggaggcaggagtgccagagcagccccctctgcgtctggggggcccagcaggaccccgtccaggtggagattgggaagggtgaaggcatccagaggtgcttccctggactcctgcctcgacaggaaaggaaatggcagggtgggggtggcagaagtctgtttcccgcccctgccc

SEQ ID NO: 29636 - DNA, 406 bp, Homo sapiens
cttgaccttttaatgataactaattatgacataaactattaaagggtgaggaaaattgtttcactttttgacagagacataggtataatcacacttacgtgctggaaatttttttttataaaagcatctccaaatataggtagtctcaaagtttaatactgtaagtggaatagaattttaatttatgtgaaagacatatcttcaactattttctaattttgaatgttcccaccgtgcttgaacaccattttatacagtcataattctgtgtttatgtcagaattatgtctttactatcaaaaacaacctctcaggttgactgttttcctgaattacaatgcatcaagttctgtaaccatttcaaataaatgtattaattattaatgtgataaatgcattagatttt

SEQ ID NO: 29637 - DNA, 352 bp, Homo sapiens
tgtgccattttgggattgctgaaacaagcacaaaccctgtattttggtagctgattgaaacccaaaccaggccccacactttgacaaataacctgccaagtctccacatttgctgagaatcacattagcctaggaaatcacggattgcttatattttacatttcaaatgtgtagagatcttggcattgatctgagggtatgccatcaccctggggattcgtctcagcagcagggctggtattcactgcaaggaaccacgctcggtactcattggatgcctatatactgtgtagtatgtcctttagtttgtttgagaccagttggggtcctttatttgcccgtcagcttagta

SEQ ID NO: 29638 - DNA, 465 bp, Homo sapiens
taaattatgctaagccagacatgtaaacttatcccctgacaatgattgattttggaatggggtgtgtgacccaatcggggccagtgagatgggagggagggtttgctgggaagcttctggaaaagttatcttgctaagaaagagatacataaaataggccaggcatggtggctcacgcctataattccagcactttgggaagccgaggtgggtggatcacttgaggtcaggagttcaagaacagcctggccaatatggtgaaaccccatctctactaaaaatacaaaaattagccaggcatggtggtgtgcacttgtagtcccagtttctcaggaggctaaggcaggaggattgcttgagcccgagaggaggaggttgtagtgagccgagagcatgccactgcattccagcctgggcaatgggagtgaaccctgtctcaaaaaaaaaaaaaaaaaaaaaaaaaaa

SEQ ID NO: 29639 - DNA, 955 bp, Homo sapiens
gaaactccgtctcaaaaaaaaaaaaaaaatggcctggccatcctgctatatttgtctcctaaagactatttcaaacttcttaactcttctcaaatctctaaaatgattccctttccctgtcttctgtctcaagtaacctccctttgaccattgaaatcattgcataatctgtctgtacccattgcctacatttcctagcatctcacgctctccttaactcacatctgactagtgtatgtggcatcaaacacagctattgccaagatcacttatggcttctgtcaccgctgccctgaggcccaggccagagggcgcttgccctagattccacactgtggatagcccattctagcccctctctagctaggctgtcttcatagggcaggtgccaagacagtaggctcagtagagcccatggctctgcttctaatcatcatgcctggaatgtcttgcttaaatagaaccaaggctattggttatattggaaaagaccagcagggctcttcccaacatccattcaactggggagtgaccaagggaggtaggaggcactatttgcataagatatgaatggtgcacaatggggaagccaagagtttccacatatatccattcaaagtacctagtgaggtgggaatgggtctgggtaggaataggtcaagcttcagtctagtcgccagagatttgtgttcagaattctaaatttaaacaggactcttcaggtcatttttttccctttggcttctttcaaaattgtctttgatttactgaagttgaatattatattgtaaccgaaaatcaagttagttgcttaccacatgtagagtccaattaacaagagtggggtctggtacaagaaaagtggatttattccaaagctagcttggggaagggacacaaaatttcttgcttttaactgtgccgtttcacctttggagctgaagtggcaaaaaaa

SEQ ID NO: 29640 - DNA, 196 bp, Homo sapiens
ttttgagccttgatttaatgaactttgtatttattgcacaatcaacagagcaacaatcggcctgtttgtgtctcttgagtttgttagggcattttgtatagacgtttccaattgtgatgtacgggaatgtgtcagcatttcccttggtgatttcttccagagccgcaacatttagaaaaaattttacttttctaaa

SEQ ID NO: 29641 - DNA, 481 bp, Homo sapiens
ttcaggcaggaagggtcagttggaaagaaacctttgacgtgagcctcttgatgtctccatggcctctgtgcctccatggctggcccaggccttctgtgcttatgccccaggaagcatgtggccagtgaatgaatgcaccccaggatgcctccttcttttccatgggagcccagaagatgccacttggagctcagcgtcctggtgtctagaaaagtttctggtgccagcagtgctgctccatttggtacagcaggtgccaagcctctcaatggaggccctttggacttctatgaaaaattattaatgagcttccagactttcatatctggcatttattctccaatggatacctgaggaaaaacctttttcttcatcaaatagaacttgaggagaaatcaaaaagacaacttcaggaggcaacagatgggaagtgcctgcctttaaacaaaacaaaacataaacaggctttatgcctttaaaa

SEQ ID NO: 29642 - DNA, 163 bp, Homo sapiens
acttatttggaataatgaatagacagacaatgtcaataactgagatatgaaatgccagaaagaaaggttgggaaagaagacgattagctcaactatggacatacagaatttaaggcctactatgcatcatgcactgagctagggagctaggcttttactgatg

SEQ ID NO: 29643 - DNA, 901 bp, Homo sapiens
gttcctgctgggtgccgaggtagcgaggtcaggggtcaagagtggaacaccctcactggcccgggccggcgcgggagggctgtgtgatggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctggtgaggcttagacacacgaaaggtgtgaggggccagcccagaaggatctgttttttaggagagtgctagaaacagacagggtgggagactaactcttaagtctggttagggcaagggactgcctacaagatgatggaaataaaaaataatttttccagagagtgagaggaagagtatacggttagattgagggaggtagagccaatgatgtgtcatttgggatatagaaggcaggtcctgggaagaaagggatacttcgctgatcctttccttttctttccatcctaattttcagcttcagtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccaggtattgcatcatctctccaagt

SEQ ID NO: 29644 - DNA, 600 bp, Homo sapiens
gttcctgctgggtgccgaggtagcgaggtcaggggtcaagagtggaacaccctcactggcccgggccggcgcgggagggctgtgtgatggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctgtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccaggtattgcatcatctctccaagt

SEQ ID NO: 29645 - DNA, 1534 bp, Homo sapiens
tttctttagaagttaaagacttttggaggaaaaacatttcagattatgtgttatagcttatagaacaaattaagtccttagctgagaatacttgtcaaaggaggtaaataaatattacataattattcctaatacaaattactcagcgaacatttgtttctatagtaaatatgctataaatagaattgttcactttatgattttttttctttcttcattttagcatttatgacattaacagagaacaggactatgtcaagaattctgagggtatacttggtgaaaatgaattaagaccaccctcccagctacattctctcttagagaagatcgagacagggtccctatcagaaaagagtgggtattaaactaagtgctataagtcataactaatgaatccagaatagaatgattaaaatgtttttagttttaatttagatcatgtaaaacaaaaagactttaaaggaagtctgatgtatacatttttctaggtcactaattttgtgccctatgaaaactttatgtaccccatagtcaagtacattttttcctatgattttttaaattttataattttagccaaatagttatagtttttatgtttaggtctgtgattcattttgagttaaattttatggtttaaggtagaggtttgaggttcatgtttttttcctccattttagttgttctgtagcagcatttattgcaaagatattctttctcaatggaattatactggcaatattgaaaatctgttatctggactctattctgttccattgatctatatgcattttctttgtatcattaccaccttgtcttgactactttagctttgtagtaattctcaaaatcaggtagtgagtccttcagctttgttctttttcaaaattgttttggcttatatctttcttatataaattttagaatcagatcatcagtttctgcaaactgagattgtgttgaatctgtagatcaattttgtgtcttaacatcccccagcaaagttagaaagccaggcagtaatatcagagggcacaagcccagattgaagctggaagacatagtgctccagaaaggtccttccaaaaaaaagaaaagaagctgctcaaaacagacaaaatctttgatctatctttatccagaggatattgttagttctctagaatttcaagctgaaataatgattggtaactgaaaattaagctattttaaattcagaaaagcaaaacacggtataaggaaagaacttgactacacagtatggtcatgcctgtaattccagcactttgggaggccgaggtatgcagatcacttgaggccaggagttcgagaccaacctggctaacatggtgaaatcccatctctactaaaaatacaaaaattagccgggcatgttgctgggcacttgtaatcccagctacacgggaggccgaggcaagagagttgcttgaacccgggaggtggaggttgcagtgaaccagaatcaagccacttacgctccagcctgggccacggagcaagactccgtctc

SEQ ID NO: 29646 - DNA, 506 bp, Homo sapiens
tccaaaaaaaagaaaagaagctgctcaaaacagacaaaatctttgatctatctttatccagaggatattgttagttctctagaatttcaagctgaaataatgattggtaactgaaaattaagctattttaaattcagaaaagcaaaacacggtataaggaaagaacttgactacacagtatggctcagcaatgattaatacatacagttaagtagtgaaacctaggcctagcacggtggctcatgcctgtaattccagcactttgggaggccgaggtatgcagatcacttgaggccaggagttcgagaccaacctggctaacatggtgaaatcccatctctactaaaaatacaaaaattagccgggcatgttgctgggcacttgtaatcccagctacacgggaggccgaggcaagagagttgcttgaacccgggaggtggaggttgcagtgaaccagaatcaagccacttacgctccagcctgggccacggagcaagactccgtct

SEQ ID NO: 29647 - DNA, 1095 bp, Homo sapiens
  misc_feature (1004)..(1004): n is a, c, g, or t
atggagcccctgttcccagcctccacgcccagctggaacgcctcctccccgggggctgcctctggaggcggtgacaacaggacgctggtggggccggcgccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgcggcctgggtcctgtctctgtgcatgtcgctgccgctcctggtgttcgcggacgtgcaggagggcggtacctgcaacgccagctggccggagcccgtggggctgtggggcgccgtcttcatcatctacacggccgtgctgggcttcttcgcgccgctgctggtcatctgcctgtgctacctgctcatcgtggtgaaggtgagggcggcgggcgtgcgcgtgggctgcgtgcggcggcgctcggagcggaaggtgacgcgcatggtgttggtggtggtgctggtgtttgcgggatgttggctgcccttcttcaccgtcaacatcgtcaacctggccgtggcgctgccccaggagcccgcctccgccggcctctacttcttcgtggtcatcctctcctacgccaacagctgtgccaaccccgtcctctacggcttcctctctgacaacttccgccagagcttccagaaggttctgtgcctccgcaagggctctggtgccaaggacgctgacgccacggagcngcgtccagacaggatccggcagcagcaggaggccacgccgcccgcgcaccgcgccgcagccaacgggcttatgcagaccagcaagctgtga

SEQ ID NO: 29648 - DNA, 426 bp, Homo sapiens
tttttttttcagcagcattcatgcaacctctgcctcctgggttcaaatgattcttgtacctcagcctcaagaatagctgggattacagttgcatgccaccatatctggctaatttttttgtatttttagcagagatggggtattgtcatgttggtcaggctggtcttggactcctggcctcaagtgatccgcctgtctcagcctcccaaagtgctaggattacaagcatgagccgctgcacccagcctagatctctgtattcatcagaactaaggcaattaaaggaattgtcttattgtgggggctggcaaatctgaatctgcagaactggccagcaagctaaagacccagggaagagttgatgttgcagttcaagtctgaacaagtctgaaggcagtctagatgcagaattattgcttccttggt

SEQ ID NO: 29649 - DNA, 400 bp, Homo sapiens
ttaaaggattgtgccattttggttttaaccacttcctcaatttggtgtgccttctttatatctgtgctcctgggttatgtaccccttttttttccccttattgaaggtgcttattgaagattaatcaagatcaacagtcccctttctttttagagtcccaactatagaattctgcttgcctcctgaagtctaggataggtgtctgggtgaataacaaagtagtgctgtaaggttggctaggcaggtagtatcctaacagtttggcaaatgaggaaactaagacttggatttggctgggtgcagtggctcgcacctataatcccatgctttgggaggatgaggtgggaggattgcttgaggacacaagttcaagaccagcatgggtaatgtagcaagagtc

SEQ ID NO: 29650 - DNA, 355 bp, Homo sapiens
gcggccgcctactactactaaattcgcggccgcgtcgcccttttttttccccttattgaaggtgcttattgaagattaatcaagatcaacagtcccctttctttttagagtcccaactatagaattctgcttgcctcctgaagtctaggataggtgtctgggtgaataacaaagtagtgctgtaaggttggctaggcaggtagtatcctaacagtttggcaaatgaggaaactaagacttggatttggctgggtgcagtggctcgcacctataatcccatgctttgggaggatgaggtgggaggattgcttgaggacacaagttcaagaccagcatgggtaatgtagcaagagtc

SEQ ID NO: 29651 - DNA, 206 bp, Homo sapiens
ggttgagaaaccctagtctaacctctggccccattaaaatgtgggctccatgagggcaggaactacatctgtctcccattccactgttcctcagtttgggacatcgtagggtgctcaaaatatttgttgtcaccaaataccagccaaaggaagcaaacaggcaaatccaaaagtgggacactctataggacacactcccttctttt

SEQ ID NO: 29652 - DNA, 268 bp, Homo sapiens
  misc_feature (243)..(243): n is a, c, g, or t
  misc_feature (248)..(249): n is a, c, g, or t
  misc_feature (252)..(252): n is a, c, g, or t
tgaacctgaggcccaggcctttcatagagtgatctataacagaaatcttcatggcataggaccctaataaaaggcctacattgatagaaggcaaattatttttaatatcccgtatgcattttctgaagggcagaagtgtattacaggtggtttatattctaaaaggaacacaaaaaaggaaactgtggtgggaagtgtgttcatttaaaccataaacatactttctatatttcaagtcgaccngccgnnaanttagtagtagtagcta

SEQ ID NO: 29653 - DNA, 313 bp, Homo sapiens
gtgtgtaaccttgccctggagcagagctagagaactcactgcaggcttcagtgaggaaatcaaacctgtggctgtcatcagggcaacttgtttgccaacaagcaagggtttggtgggtaaaacgatcccttcctcctggagttccttccttccccaaatatactttagatgtgatgggtgtgagtgaaacccaaactcaagtttcagctccttcagggagccactaattgcctttctcatggtttcatccaataaagttgatctgagaaaagtgcctttcacattgaagccagccctctgtgtgctgatggac

SEQ ID NO: 29654 - DNA, 375 bp, Homo sapiens
gtgaaccacagtgccatgcctctcctcagtactttctcatggtggattatgaggtttactggcctggctggtgggatcgggcattctcccggccccagtgtgaatgctgtctgcggtgccctagaatccttttcggtggttcgttccctgacctcagtcatttccttgcctgcaggggctgattaggccctctgcctcctactcgaaggggatcctcagcagatcttggtggctttcatctctccagtcctctgttccgcacactctgactgcctcggcctcccttggctctcagctccatgtcttcaattcgggaggctgccaggcaccacccgcgtcccccctccatgtgctcagcctggccactccccaggt

SEQ ID NO: 29655 - DNA, 424 bp, Homo sapiens
tggatcatttgaggctaggagtttgagaccatcctggccaacatggtgaaacccccgtctctactaaaaattcagaaaattagctgggcatgttggcatgcgactgtaagcccagttactggggaggttgaggcataagcattgcttgaatctgggaggcagagatttcagtgagccaagatcgcaccactgcactccagtctaggcaacagagcgagactctgtctcaaaaaaaaaaagaaaaaaatataaaatttttgatatactattgtgcttagaaaggaagacatatttataatttatttcatggtgggtgctgtagctcacacctataatcccagcactttgggaggctgacatgggcacatcgcttgagcccaggagttcgagatcaggctaagcaacatggcacgactctgtctct

SEQ ID NO: 29656 - DNA, 226 bp, Homo sapiens
  misc_feature (14)..(14): n is a, c, g, or t
attcgcgggcgcgncgaccacaggaaccgctggtagggaagggctcttggtgctgtgagcatctgtgatttttgagacctgaggacgtggctcctgtgtccctcaataccacagtcctacccagggaacattcactaaggacacattaggagcgagtgctcagttagacactgggagtgtaacgacgaataaaacacttccttctctcaagaaactcataggtaag

SEQ ID NO: 29657 - DNA, 370 bp, Homo sapiens
tctccttgatggacagaaaagaagaaccacatcccacaataaaacccactgggctctgagaaaaggtgattctgatagaaaataacaggtatgctctaaattcaaatggggctatagttgagcagattcactccagtcccggaattaacatcacgaccaaatgaaaggagccacgtcctcaggtctcaaaaatcacagatgctcacagcaccaagagcccttccctaccagcggctcctgtgtccctcaataccacagtcctacccagggaacattcactaaggacacattaggagcgagtgctcagttagacactgggagtgtaacgacgaataaaacacttccttctctcaagaaactcataggtaag

SEQ ID NO: 29658 - DNA, 446 bp, Homo sapiens
ttttggcggccttgtccccattctgtgttgtgcattcccaaggccacaagatactgccaagccagaatgattcaatttttaccgttatctacctctcactcctagtttattactttattgagacgcacagcactagagaattcttgctatgtgaatgatttcttttggccaagtgcggtgtctcatgcttataatcccagcgccatagaggatgaagtggtaggataacttgaggccaggagttcgagatcggcctgggtaacatagcaagacccgtttctaccagaaattaaaaaaataaataaataaatagccagcggggtggtgcgtgcctgtagccccagccactcaggagaagtgggaggattgcttgagcccatgagtacgaggctgcattgagctacaatcttgctactacactccaacctgggcaacagacctctcag

SEQ ID NO: 29659 - DNA, 447 bp, Homo sapiens
atatacagtccacccacatttagtgtgggtcatggctacagattctgacaaatccatttctgtgtgccaagttccctaaaaatgggaatgattctttacacagtgttcacaggttgaattgttttctcattaacaatatctcaggcacatctttctacatcagtacgtatagatctacctcattctttaatgactgcaaagtgttacagtatcatcatttctttaaccagtatgcaactcttggccatttaggttgttctaatttttcactcttagaatggatgctttggtaaacatcctttcacatataactttatgtgagtatttctgtaggagagatttttagaagtgggatcgttatgtgaaagtatagcctcatttttaattttgatagagtctgcccaattaacttcctaaagtatttttctattttattctcccaccaaa

SEQ ID NO: 29660 - DNA, 322 bp, Homo sapiens
gtttcttcatgctcctttatactccgtccctctcatcctttcctgcctgcctgcctctatccccaggtaaccactacagattagtctgcatttctagaatttcatagaaatggagtcttacagtatatactcctgtttgtctggtttcttccactctgcataaatccatgttgtgagtaccaacggttcattcgtttttgttgctgagtaatactccattgtatggatgtaccacatttgtttatccattcacctgctgacggacatttggattgtttccagctttgggcaatcacaaataaagctgacttgaacattcacg

SEQ ID NO: 29661 - DNA, 360 bp, Homo sapiens
tggagacagagtctcgctctgtcgcccaggctggagggcagtggtgcaatctcagctcactgcaagctccgcctcccaggttcacaccattctcctgcctcagcctcctaagtagctgggactacaggcacccgccaccatgcccggctaattttgtattttttgtagagatgggtttcaccgtgttagacaggacggtcttgatctcctgaccttgtgatcagcccaccttggcctcccaaactgctgggattacaggcgtgagccaacacatccggccctaaaattactcatcttctaactaggacaacatccattatctcatttcaggctccaaccaactgcgtgcagcacagttcc

SEQ ID NO: 29662 - DNA, 562 bp, Homo sapiens
aatccttgcctgtcgacttttttttttaatgggaatatatctaacaatacatccttagaatatgaggaactggtttttaaatgaagttgacaaagttaacagagacttcccaaatgtctcaagacttacttgtatacacatgcacacacacatggtttaacttaggagttttaaatgttttataaagaaatatgagatgtgtagagagactgtggatccactgaaaatggatgagcaaactgaaatggggtgtactagtttcctctggctgctataaaaaattaccacaaattgaatggcttaaaacagaaattttacatttttagaagccagaagcacaaaattaaagtgtttatagagccacacctctttgggaggctctaagatagttcttcgcctcttctagattctggtggctgtcagtgtttgttaacttgtagctgtatcactccagtctctgcctccctggccacactgccacctcctcttcgatgttatctaccttgccttttctaacaaggacacttataatggcatttaaggcctgaccagaaaaatctta

SEQ ID NO: 29663 - DNA, 371 bp, Homo sapiens
ggtcctgggcattgagacagtgttttcaaggttgggtccacatttgactgtgtgtggttgggttaatgggcctttgatgctcgctgcagtggtatttgggtcactcgtgttgctgcctgcctctctagactggagagcccccgccccctttagcagctggctgctgcttcctgctggctctcctgggccccaagctctcaaggctgtcacgaatcctaaaagagtccttcaaaccagtgtcactgtgacttaacatctatttcaaaagatgatctatggcacatttggaggacaatgcagaggggggtgtcacaaactcaagcacatttggataaggttattgacctggctttttcttagtttgctatgtg

SEQ ID NO: 29664 - DNA, 1928 bp, Homo sapiens
aggaagaaaatataaagtacacttttaaaacatgaagtcttcatagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaa

SEQ ID NO: 29665 - DNA, 2042 bp, Homo sapiens
aggaagaaaatataaagtacacttttaaaacatgaagtcttcatagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataagtttgaagataattgggagtctgacagaacaattaaaattgaattattgtttctaatagattttaagcccattctgcagtggaatttcatgaactagcaagaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctcgacctcaagaggatcagcctggccagggtggcacaactcttccttccccgtgcacagcaggaaagcttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaa

SEQ ID NO: 29666 - DNA, 2053 bp, Homo sapiens
aggaagaaaatataaagtacacttttaaaacatgaagtcttcatagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggaaaacaaactcaggaagaaaaagaaaagcagaagtgatcaaggagagcgctcgagttgcaatattttcctttggctgctgacaggcagttactataaagcattgtgcatggtgacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctcgacctcaagaggatcagcctggccagggtggcacaactcttccttccccgtgcacagcaggaaagcttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaa

SEQ ID NO: 29667 - DNA, 1808 bp, Homo sapiens
aggaagaaaatataaagtacacttttaaaacatgaagtcttcatagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaacgtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaa

SEQ ID NO: 29668 - DNA, 1764 bp, Homo sapiens
aggaagaaaatataaagtacacttttaaaacatgaagtcttcatagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaaggtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaa

SEQ ID NO: 29669 - DNA, 198 bp, Homo sapiens
ggaagaaaaagaaaagcagaagtgatcaaggagagcgctcgagttgcaatattttcctttggctgctgacaggcagttactataaagcattgtgcatggtgtatgaaagacaaaactagttctcctttcttggtttcttttgaatctttgtgatatggtagagaaagtttgataaagtgttcttgtgcctgctgtcga

SEQ ID NO: 29670 - DNA, 1940 bp, Homo sapiens
aggaagaaaatataaagtacacttttaaaacatgaagtcttcatagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctcgacctcaagaggatcagcctggccagggtggcacaactcttccttccccgtgcacagcaggaaagcttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaa

SEQ ID NO: 29671 - DNA, 1900 bp, Homo sapiens
aggaagaaaatataaagtacacttttaaaacatgaagtcttcatagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggaaaacaaactcaggaagaaaaagaaaagcagaagtgatcaaggagagcgctcgagttgcaatattttcctttggctgctgacaggcagttactataaagcattgtgcatggtgacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgacgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaa

SEQ ID NO: 29672 - DNA, 1846 bp, Homo sapiens
aggaagaaaatataaagtacacttttaaaacatgaagtcttcatagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaa

SEQ ID NO: 29673 - DNA, 1119 bp, Homo sapiens
catcaaaggtggcaaataagtactgtcttaccacacctcttttccttcctctctgttctaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaa

SEQ ID NO: 29674 - DNA, 300 bp, Homo sapiens
tttttttttttaacattaagagccaagtattagacctcattctgttctgttccttaatatcttcatcccagtcctccagccccatcttggagtagagtttgggcaacttttttaagctctccttactctcaatttgaggtgaatgccagcttcaagtctaaacagtcttttcagtagcaggattgatgcaggactaatttattaaatcctagctctccagagtggtacattgtgattgtctgctgagggatcatctctgcatttaaacttattgggtcagtgcctatttgcatgtgaact

SEQ ID NO: 29675 - DNA, 410 bp, Homo sapiens
gcttgcaaactgctgaaatgcacttgaatttaaaattgtaatgcatctgttttctcaaacatagtatgataagaggattttcagatagcaaatgcccaataccagttcttcccctctgacatgctgtaacaaggaattaggagtgttgtatgctgcttcttccttcaacaagtgttctccaaaggcctatttaataatttgattgtaactaggaactacatattattcacattactttctacttataatgtttcttcctatattttttctttttatgttttatatttgagtccaatacctagttgtttttagggcagtttcacataaattatcttatttgaatgatctcagctgaatcatttaaaaacaatcctgggtagcagagtaagtgggtctatccccacttgaca

SEQ ID NO: 29676 - DNA, 532 bp, Homo sapiens
gtggtgtccctgagcccgggaacccagtgtggggggcctgccatgatggccacaaggtaacctcaggaggaacctgggaaacgttttatattaaagttttcatttaatggtccattctgtttgtcaagtggtgcatatagaaaaattgtggcagttgcatggaatttcatttggaaacaaatttaaataaaaagtgagtcaatttaaaggaactcattaagtaagtatcgtgaaactgaggcttggaggaccatagtttggataaaaaatgccttaagttgaagtgaaatcagaacctcaaagcgagatgtgcaatctcatgttcatttcagcattattcacagggccaatatctgaaagcaacccagatgtccatcaccagatgaatgataaagaaagtgcagtgggctgggtgcagtggctcatgcctgtaatctcagaactttaggaggtcaagacaggaagatcgcttcagcccaggagcttgagaccagcctgggcaacatagcaagtccccatctctacaaaaaat

SEQ ID NO: 29677 - DNA, 433 bp, Homo sapiens
caattaaaacaacttcacacacaaattaagtagaaataaaatctattaaatatattttaaagcaatcccgtggttttataaaggtcttgggccataatttctctgttgctgtaaagaggcaaccttattttagcaaagtatatttttaattcaacatctggattctgtatagaaaaattaacaaggaaatatgtgagattcctacaatggaagacttttcacatattgcaagcaatgcatctccatcctactttgtagtaatactgatgtgggcataaaggaaagacaggaagaggatgactagacaccaggtgatttatacattatcttattaaatcatgaaacagctcggccaggcacggtggctcatgcctgtaatcccaaggtgctgggattgcagacatgagctactgcacccagccatttattttct

SEQ ID NO: 29678 - DNA, 2512 bp, Homo sapiens
gaccttaaatatatcgaggtggctaattgatgtataataatttacaaaattattcttctattgctacagagctacaattcaatttacagtaggccaccatgagggccttcttaaggaaccagaaatatgaggatatgcacaatattattcacattttacagatcagaaaattgaggcacagattaagtaacttcccaaggctaccaggcattctagctccagaaactgtgctcttaccattctgctacaaggtatttcgaaaaaaagaaaaagtaaaaagaagtcaaaaggcaacagagttcattgattattccatagaacagtcacaccatgcaattctcacacccttgcagacacacttgaccatgaaaggttcctcaatgaaatgttcctcattatcttcagaagccatattattcacattgactttgcagttaactcagaccctaggtctggaatgctgtcttctctacttatccaaaactatacatccacagatcatataaactctcagccctgctgcaaagcctttccagaaaaataaaaatggttgaaaaggcaattctgctaccaatgactgtttaagcccagccaagtaactgaaccattccaacttcaatttacttatgaaaagaatttgatgatgtaggaggttatttcaattctaaaatacaaacccatgttgatctttctcaatcttgaactcatagattattatctattatctcaatttagtttgttatttatcctagtgggccattaaaaactaccacatgtgtttctgtctctccattagtcaataactaaactaacgagcaattagtaagccatgtgccagatgctccgctaggcaccagagggataaaaacaatacttatagtataccactaattttcgcttagtaactagtgaaatgttcaagtcatgcctgagtcaagagttgaggagacattacaatgtgtaatggaaaccaaggaaagtgaaactttggataagtggggactagtgtatttatatatttaattgatttctgactctatcattggcctccaaacacagattgtgtttttctttggttttgttttcttcactatgggatcttctgtgcccagcacagtgcctgacacatagaaaacaatcaatatttgctgaataaatgattaaaaaatcagagaactttcccattctgtttggatctatagaacatccagagtaagtgatgagggcctctgcatttatatgcgcttaaattaagattatgtgagaaaagtttaaagacacttagtagagtgattttgaaatatagtaaacacttggaaatggtggtgctttaaaaagatattaatagataatatgaaaatctccatctcaaaaataatgcataaactatttaaaggaaaatcacatctccaggctttcaatgtttgttcattactttttcatatatttttaccatctgctgaaggcagtcatatcaaagggtaaagaaagatgggaggaaaactcagtaagaattatattagtctgtttgcaaagtagaaaaagattctcatcactcaaccttatgagcaggaagagggaaggctgtttgagaaccatttacttagcagaaccacatattttagacacttccctgcattaactgcacaaacaatatgtttgcaaacttgttagatcaacctccaacaacgacacattcaggagttaaatatttttcatcaaacattggatttttccttaacgctagagattgctacaaatcttctgaagggtctcaatggcttcaggctaagaagagatttctccctgttataagcagcaagacaaattagccatttcactctcaaacttcactaatgatcacattctttccaaaaggaactctagaagaccaaatgccccgagttaagaacatcaaaactaaccatctgaagaaacttcccaagtgtaagactctgccattaaaacattaccgagaggggactcaaacagtctttcttcctttgtcgtgtttcttgctcccagaccaaggcactgacgacagtactgatacataatttaaaagcacactcccttccactttggtaataccagaactctaattggaccaccctgaagcttaggactaccagccatacaaatagtaaactctgtccacgattcactcatctgtgtattttctatagatgtttactaggcgtttgttatataaaaataccccggccaggcacggtggctcacgcctgtaatcccagcactttgggaggtgggtggatcacctgaggtcgggagttcgagaccagcctgaccagcatggtggaacccccatctctactaaaaacacaaaaaattagccgggcgtggtggcacatgcctgtaatcccagctactcaggaggctgaggcggagaattgcttgaacccggaaggtggaggttgttgcggtgagctgagattgcactattgcactccagcctgggcaacaggagtaaaactcccccccacccaaaaaa

SEQ ID NO: 29679 - DNA, 2088 bp, Homo sapiens
gaccttaaatatatcgaggtggctaattgatgtataataatttacaaaattattcttctattgctacagagctacaattcaatttacagtaggccaccatgagggccttcttaaggaaccagaaatatgaggatatgcacaatattattcacattttacagatcagaaaattgaggcacagattaagtaacttcccaaggctaccaggcattctagctccagaaactgtgctcttaccattctgctacaaggtatttcgaaaaaaagaaaaagtaaaaagaagtcaaaaggcaacagagttcattgattattccatagaacagtcacaccatgcaattctcacacccttgcagacacacttgaccatgaaaggttcctcaatgaaatgttcctcattatcttcagaagccatattattcacattgactttgcagttaactcagaccctaggtctggaatgctgtcttctctacttatccaaaactatacatccacagatcatataaactctcagccctgctgcaaagcctttccagaaaaataaaaatggttgaaaaggcaattctgctaccaatgactgtttaagcccagccaagtaactgaaccattccaacttcaatttacttatgaaaagaatttgatgatgtaggaggttatttcaattctaaaatacaaacccatgttgatctttctcaatcttgaactcatagattattatctattatctcaatttagtttgttatttatcctagtgggccattaaaaactaccacatgtgtttctgtctctccattagtcaataactaaactaacgagcaattagtaagccatgtgccagatgctccgctaggcaccagagggataaaaacaatacttatagtataccactaattttcgcttagtaactagtgaaatgttcaagtcatgcctgagtcaagagttgaggagacattacaatgtgtaatggaaaccaaggaaagtgaaactttggataagtggggactagtgtatttatatatttaattgatttctgactctatcattggcctccaaacacagattgtgtttttctttggttttgttttcttcactatgggatcttctgtgcccagcacagtgcctgacacatagaaaacaatcaatatttgctgaataaatgattaaaaaatcagagaactttcccattctgtttggatctatagaacatccagagtaagtgatgagggcctctgcatttatatgcgcttaaattaagattatgtgagaaaagtttaaagacacttagtagagtgattttgaaatatagtaaacacttggaaatggtggtgctttaaaaagatattaatagataatatgaaaatctccatctcaaaaataatgcataaactatttaaaggaaaatcacatctccaggctttcaatgtttgttcattactttttcatatatttttaccatctgctgaaggcagtcatatcaaagggtaaagaaagatgggaggaaaactcagtaagaattatattagtctgtttgcaaagtagaaaaagattctcatcactcaaccttatgagcaggaagagggaaggctgtttgagaaccatttacttagcagaaccacatattttagacacttccctgcattaactgcacaaacaatatgtttgcaaacttgttagatcaacctccaacaacgacacattcaggagttaaatatttttcatcaaacattggatttttccttaacgctagagattgctacaaatcttctgaagggtctcaatggcttcaggctaagaagagatttctccctgttataagcagcaagacaaattagccatttcactctcaaacttcactaatgatcacattctttccaaaaggaactctagaagaccaaatgccccgagttaagaacatcaaaactaaccatctgaagaaacttcccaagtgtaagactctgcctgcacgacaacacataaaaaaagagagaagaatcaaatagacacaataaaaaatgataaaggggatatcaccaccgatcccacagaaataaaaactaccatcagagaatactacaaacacctctacgc

SEQ ID NO: 29680 - DNA, 768 bp, Homo sapiens
agttaccaaaagcagaaatcatacaagacagattataatgcaataaaatgagaaattaataacaaaagtttaaacaaaaagttcaaccgcttagaaatttaaaaaatattttattgggacttccagtatgaacatggctgcataagtcagcatttttccccttttctcttggaaatcattcaaacccacaaaatccattttcagaaaagttggaaacaaacagaagccacagacttcaaaatatatgtaagggctgctcaaagacaactgaaattggttagaggccactcagcagtaagtgaagagaagatacatgcagaatgttgaaagatcagagtagtagcagatctcagaaagcctagcaaaaatatactttctaatggaagaatgttggataattatttaggaccagataatggttaccatgggggtttattatcctattctcctttacttttgtgtgtgtttgaaaattttcataatagtttcaaaatacagttcctgaaagtgaggtttcaccatgaaatataaatgttacatcctttgtttacaaccgtggatacggaaactttggagacaggttgaagctgatgacagaagcctcttagacctgatttgattcagagaagcagaggtggagctacacaagaattacacaaatgagccatatttgcaggaagcagtctgcctctgtggtgggaacaaaattcagctcatttagtgagaaataattttttaaaacggtgtagcctgaattcaaaaatcctg

SEQ ID NO: 29681 - DNA, 437 bp, Homo sapiens
tttataaatacacagactaaggaaaggtctgaaaaaaaaggtaacagtggttatcttcagggagaaaaattgagggactgatgtcacatagaaaactaaatataataatccagatttagtaggtaaaggtgattagtattattgtaagggggtgcaagggactattgctctaggcaggatacaccaacagtaagatctgcaagcttctcaaggtttaggcaaaaatgacttttcttttataggaatgagtaaatcaagccaaaaatgagcaggggtgggcagtgggatgaacgagagtggcatcgtggaacagcagatcagagaaggttttacccccaggccagcttgttctctggagtggctggtttagactgcggctgggccagaatgtcagagtcttggggaaagagcattttgtcccgattgatcagcaggga

SEQ ID NO: 29682 - DNA, 1554 bp, Homo sapiens
actgacgtccgaaaggattagagagaaaaatgtggtcagcgcttaatatggagggcacagtgggtgtgctgctttctcttttccatccctctgtcaacttcattctcttttgggggcaaacaagactcagatctaaacagagtttatggtttgttttgcattttgtatttattaatatttatgccgactttgaaggtgctgaccagaaggcatcagtaacacacacacgcacacgcacacacaccacacaccatgtctgtttggtttgattctgagcctgagatcctggaaatatttcagctgttgttaagaggctggagttaggacccaggaaggacacagcagtggggatataaatagaaaaggagaacagaacaaagtttgaggagagagacttacatcactcactccccctccacccagagagcaggacggaggtgtgaacttgagccagaccagaaggagctcgagagcggccgcaggacaagcccgaggagcaggcgggcgctccaggggaaaaccacgcacaaaaccttcttcagagaaaagggaagctccaaacctgactgagacaaacggaggctcttgaaataaaaagaaaataccgcaggacaaacagcctcccgtccccgggcgcaggtcgcggtcacagtggtgacctgggattgctttcccaggactgcgagtcgggtttgggtttctcctccctgcattccacagctgctctggtcatcgcaacgtgtttattgatcactgaagaatctcaagttttgagacgaggaagaaacacccattaggtctccaagacagctgtgtttcacaaactttaaggagacagaaattttctcccctggaacctgtgaaaatgtcccttttccaaggaagtgaaggttaagaggtcccgttctcacagaccctcaggaatttcacttggctccgagctttgacctccgagagagccatggaaaagctgctgcggctgtgctgctggtactcctggctgctgctattttattacaactttcaggtgcgtggcgtctactccagatcgcaggaccatccaggatttcaggtgttggcgtctgcttcccattactggccactggagaatgtggatgggatccatgaacttcaggatacaactggagatattgtggaagggaaggtcaacaaaggcatttacctgaaagaggaaaagggagtcacgcttctctattacggcaggtacaacagctcctgcatcagcaagccagagcagtgtggccctgaagatttccagtttttcttgataaatctctcctgacttctctggctggctggagctaagtcgcggtggccctggacttccgtctccagttcccctcagtccccaccagacttctcgactcttcaataatcttcaggtcgaacagagcctgtccgcagcatgagctctggggccagaaggcgtgggttccacttccggttccgacctgtttgtggggatcttgggcaaccactgcttccctttgaaaagcctcatctgtaaagtgagtgaataaaaggaccttccca

SEQ ID NO: 29683 - DNA, 1650 bp, Homo sapiens
actgacgtccgaaaggattagagagaaaaatgtggtcagcgcttaatatggagggcacagtgggtgtgctgctttctcttttccatccctctgtcaacttcattctcttttgggggcaaacaagactcagatctaaacagagtttatggtttgttttgcattttgtatttattaatatttatgccgactttgaaggtgctgaccagaaggcatcagtaacacacacacgcacacgcacacacaccacacaccatgtctgtttggtttgattctgagcctgagatcctggaaatatttcagctgttgttaagaggctggagttaggacccaggaaggacacagcagtggggatataaatagaaaaggagaacagaacaaagtttgaggagagagacttacatcactcactccccctccacccagagagcaggacggaggtgtgaacttgagccagaccagaaggagctcgagagcggccgcaggacaagcccgaggagcaggcgggcgctccaggggaaaaccacgcacaaaaccttcttcagagaaaagggaagctccaaacctgactgagacaaacggaggctcttgaaataaaaagaaaataccgcaggacaaacagcctcccgtccccgggcgcaggtcgcggtcacagtggtgacctgggattgctttcccaggactgcgagtcgggtttgggtttctcctccctgcattccacagctgctctggtcatcgcaacgtgtttattgatcactgaagaatctcaagttttgagacgaggaagaaacacccattaggtctccaagacagctgtgtttcacaaactttaaggagacagaaattttctcccctggaacctgtgaaaatgtcccttttccaaggaagtgaaggttaagaggtcccgttctcacagaccctcaggaatttcacttggctccgagctttgacctccgagagagccatggaaaagctgctgcggctgtgctgctggtactcctggctgctgctattttattacaactttcaggtgcgtggcgtctactccagatcgcaggaccatccaggatttcaggtgttggcgtctgcttcccattactggccactggagaatgtggatgggatccatgaacttcaggatacaactggagcgtcccgaacccacaagctcactgtgcttccttcccgtaatgctacttttgtgtattccaatgattctgcctactcaaatctctctgcaactgtagatattgtggaagggaaggtcaacaaaggcatttacctgaaagaggaaaagggagtcacgcttctctattacggcaggtacaacagctcctgcatcagcaagccagagcagtgtggccctgaagatttccagtttttcttgataaatctctcctgacttctctggctggctggagctaagtcgcggtggccctggacttccgtctccagttcccctcagtccccaccagacttctcgactcttcaataatcttcaggtcgaacagagcctgtccgcagcatgagctctggggccagaaggcgtgggttccacttccggttccgacctgtttgtggggatcttgggcaaccactgcttccctttgaaaagcctcatctgtaaagtgagtgaataaaaggaccttccca

SEQ ID NO: 29684 - DNA, 569 bp, Homo sapiens
cttttctcttagaacttttccttttgaagataaaattagaagacataccaatagaatatcattttatgtgtgcattgtctaatttttttcagataaaattggaatgttggcttctttgctttaattaccatagagaactaagtgtaattttgggaaatatttgtgttaaaaattatataatttattattttaataactttctaatatagcataaaatgaaaatttatagcatggtgaaaattatgctaagtagccatcaaattctttgtgaaattagtggatgtaaacaaagtcttaaaataaaaagctgaggtgggcagatttcatgagctcaggagttcgagatcagcctggccaacatggagaaaccccgtctctactaaaaatacaaaaaattagccgggcgtggtggtgtgctcctgtagtaccagctactcaagagcctgaggcacaagaatcacttgaacctgggagatggaggttgcagtgagccaagatcacaccactgcactccagcctgggcaacagagcaagactctgtctccaaaaaaataaataaataaataata

SEQ ID NO: 29685 - DNA, 1207 bp, Homo sapiens
ggcctccagtagaatatgggatgatggagatgacttttgtatcttcagtgaatcaaggcgcccttccagacctagcaacagtaacataagcaaaggagagtcacgcccaaaatggaaacccaaagccaaagtaccccttcagactctacatatgacttctgagaatcaagagaaagtgaaagctcttctccgagacctgcaagaacaagatgctgatgctggatctgaaagaggcctttctggggaggaggaagatgatgagcctgattgctgtaacgatgagcggtactggccagctggacaggaaccttccctcgttcccgacttggatcctttggaatatgctggcttagcctcagtggagccttatgttccagaatttacagtctccccatttgcagtgcaaaaactttccaggtatggtttcaatactgaacgctgtcaagcggtcctgaggatgtgtgatggagatgtgggagcatcactagagcatctccttacccagtgtttttcagagacatttggagagaggatgaagatctctgaggcagtcaaccagataagcttggatgagtgtatggaacagcgacaggaagaggcatttgctctcaagtccatctgtggagaaaaatttatagaaagaattcagaacagagtctggaccattgggttagaactggagtatctgacaagtagattccgcaaatccaagccaaaagaaagtaccaaaaatgtacaagagaattcacttgaaatctgtaaattttacctcaaaggaaattgtaaatttggatcaaaatgcagattcaaacatgaagtgcccccaaatcaaattgttggaagaatagaaagaagtgtagatgattctcatcttaatgctattgaagatgcatcttttttatatgaacttgaaattcgattttctaaagaccacaaatatccctaccaagctccgctcgtggcattttattccaccaatgagaacctacctctggcttgtcgtttacatatttctgagtttctttatgacaaggccttgacatttgcggaaacttcggaacctgtcgtatattctttgataacccttttagaggaagagtcggaaatagtcaagttactaacgaatacccaccacaagtatagtgaccctcctgtgaactttctgccagtaccctctaggaccagaataaataatcctgcctgtcat

SEQ ID NO: 29686 - DNA, 348 bp, Homo sapiens
atattcaacctgtaatagtaaggcttcacatccaagaacaggacatattgttctatgaacgttaatggtttttttttttcacagagatcttacacatttcttgctcaaaatatagtaaaagttactaattttcatgtgttgaatttgtttgatcctcaggtgtttcttttattttctctagtgacttcttgctgctagttttgaaggacattgtatcgcagaggccaggtcttcaagttattttaatgagtgcaactctaaacgctgagcttttttcagactattttaattcctgccccgttattactataccaggtgaataaaatgcatcattaaatatgtatcatt

SEQ ID NO: 29687 - DNA, 4532 bp, Homo sapiens
gtggtttagagccaggcgggcgtggtaacacatgcctgtagtctcagctacttggaaggctgaggcaggaggatcacttgagacaatgccagcctggaaaacataatgagtccctgtctctaaaaacaaaacaaaacaaatactgcgatttaccttagaaaaaattaatatataaaaggagaaggataaggaaggacttttaccctgtttcaaagactcaaaggataaataatgtgcccaagatcgcatagctagtaagtggtttagccaattctgtttctaaagtccattttgtttttaccccattcacatgaagattattttaaaagaattcataagtgaatcctgagggcaaagttagagataggacagaggcaagttgcttaaccaatatgggaattggattaaatgctctctaggccctccagttttaaagttctgtgagtctgatttttgacaccatgtaacaccatcacatatgtagtacaatacccaaagaacatcacaatgtatataaattgcactgtaggtaagatgatagaaacaaaaaattagatattcaatttgatcagtgtgataagtttatgataaaattatatgtaggaaatagcaagttcctgtaaatttattacagtattcaaaagtatagccagagttttaacaaacaaggcaatttttatagcattggccattaaatatgaaattgatttatatagttgtagtgactgcccaaaaataaccctttagtgagtgcttttctattattgatttaggtaaaaatctgatattgcttagagctacgctgtctgatatggtagcccctacccatgtttggctgtttatattaattaattaaaattaaaaattcagttcctcagtaacactattcttcacatttcaggtgctcaatagccacatgtagccaggtgttgctgtattggacagcacaggtatagaacatttccatcaacacggaaagttctattggacagtactggtatagagactcttgttgggaagaactggatatgtgctaagcaagagggctttatttcacccagaaaatctttcggtttattcagatgttggaaaactaatgtacagattccacaactcattctggctgattctctgagcagcattctgaataaagtcttctacatccaatcccaacaaatccaacaaaggatcactcaaggccaggagtgcaagaccatccagggcaacataacaagactctgtctctataattaaaaaaaaaaaaaagctgtaatcccagcactttgggagaccaaggcaggtggattcttgagcacaggagtttgaggccagcctgggcaacatggtgaagtcctgtctctacaaaaaaatacaaaaagccgggcttccagacagttccagtccattctgcaagagaggcaatcactccctgcttgggaagaaagagaaaccattcttaacttattgcgtaagcaccaggtggttgtcataagtggtatgactggatgtgggaaaaccacacaaattccgcagtttattctggatgattctctgaatggaccacctgagaaggtagccaacatcatctgtacccaaccccgacgaatctctgcaatctctgttgctgaacgcgttgctaaagaaagagcagagagggtgggtctgaccgtgggataccagattcggttagaaagtgtcaagtcctcagccaccagactgttatactgcaccacgggagtgctgctgagaaggctagaaggagatacagctctacaaggagtttcccatatcattgttgatgaagttcatgagaggacagaagaaagtgacttcttgctgctagttttgaaggacattgtatcgcagaggccaggtcttcaagttattttaatgagtgcaactctaaacgctgagcttttttcagactattttaattcctgccccgttattactataccaggtcgtacatttcctgttgatcaattttttttggaagatgcaattgctgtgacaaggtatgtattacaggatgggagcccatatatgcggtccatgaaacagatttcaaaggaaaagcttaaagcaaggcggaacagaactgcatttgaagaagtggaagaagacctaaggctctcccttcacctccaggatcaggattctgtcaaagatgcagtgccagatcaacagttagattttaagcagctcctggcccgctataaaggggttagcaagtcagtcatcaaaacaatgtccatcatggattttgaaaaggtgaatcttgaattaatagaggccttattagagtggattgtggatggaaagcactcctaccctccaggtgctatacttgtatttttaccaggactagcagaaatcaaaatgctttatgaacagctacagtctaattctcttttcaacaacagacgtagtaatcgatgtgttattcacccacttcattcatctttatccagtgaagagcagcaggctgtgtttgtaaaacctcctgcaggagtaactaagattataatttccaccaacattgctgagacatccataaccatcgatgatgttgtctatgttatcgattctgggaaaatgaaagaaaagagatatgatgccagcaaagggatggaaagtctagaggacacctttgtatctcaagctaatgctctacaaaggaaaggccgagcaggccgtgttgcatctggggtctgcttccatttattcactagccatcactacaatcaccagcttttaaaacaacagctaccagaaatacaaagagtgccattggaacagctgtgtctaagaattaaaattttagagatgtttagtgctcataatctccagtctgtgttctctcggctcattgaacctccacacaccgattctcttcgtgcctcaaaaatacgattacgagacttaggagcattaactccagatgaaagattgacccctcttgggtatcatttggcctctctgcccgtggatgtgagaattggcaaactaatgttgtttgggtctatcttccgctgtttggatcctgctctcaccattgctgccagtttggcttttaagtctccgtttgtatctccctgggataaaaaagaagaagctaaccagaaaaagctggaatttgcattcgcaaacagtgattatctggcccttctacaagcgtataagggatggcagctaagtacaaaagaaggcgtgcgtgcaagttataattactgcagacaaaacttcttgtctggaagagttctgcaggaaatggccagcctcaaacgacaattcacggaactgttatcggatatagggtttgcaagggaagggctcagagcaagggaaattgagaaaagggcccaaggaggagatggtgtcttagatgccacaggagaagaggcaaactcaaatgctgagaaccccaagctgatatcagcaatgctgtgtgctgctttgtatccaaatgtagtgcaggtgaaaagcccagaaggaaaatttcagaagaccagtactggagctgtcagaatgcaaccaaaatcagctgagttgaagtttgtcaccaagaacgatggatatgtacacattcacccttcatcagtgaactatcaggtgagacactttgacagcccctacctgttgtaccacgagaagataaaaactagtcgagtattcatccgagactgcagcatggtgtctgtgtacccgctggtcttgtttggaggaggccaagtgaatgtgcagcttcaaagaggagagttcgttgtctccctggatgatggttggatccgttttgtagctgcttcccatcaggtggctgaactggtaaaggagcttcgttgtgaacttgatcagcttctccaggataaaattaaaaacccaagcattgatctgtgtacgtgtcctcgaggatcccggatcatcagcacaattgtgaaacttgtcaccacacaataaaaagcagtcttagagagtgcttgctactcacctgcttctagctcacctgggaaataacagcagaacctctacctcgaactaaagacctattggggctggccctggtggaggagcccagggcatgaagcccaaggcagctgaggcagtgtatatacccttagggccatttctaacaaagccttggccactcccagcacaatttggagtgtcaagggtgagagcctaaaacccagcttgcctgtctttgtctctgtgattgttctggagtgaattaagttcacctgataactcaaaagtgaatgtataatacaattctgttttaatctgtgtattctttttctcctactttttactggggtgagaggggcatgaagagaaatacgccttttttttttttcttttcctgtcgccaaggctcgactgagagaagtcagaacagagaaggggaaaaaaaacccaaaattatgtgaacaagcaaaattaaaatttcattttaggctattggctactgagtaaacttgacttgtgaggggtttttatttttactcattaaaagtcaacttaaaaaaattgaa

SEQ ID NO: 29688 - DNA, 3186 bp, Homo sapiens
aaatggtaaaatctgcaagcagttccgaatgaaacaggcttccagacagttccagtccattctgcaagagaggcaatcactccctgcttgggaagaaagagaaaccattcttaacttattgcgtaagcaccaggtggttgtcataagtggtatgactggatgtgggaaaaccacacaaattccgcagtttattctggatgattctctgaatggaccacctgagaaggtagccaacatcatctgtacccaaccccgacgaatctctgcaatctctgttgctgaacgcgttgctaaagaaagagcagagagggtgggtctgaccgtgggataccagattcggttagaaagtgtcaagtcctcagccaccagactgttatactgcaccacgggagtgctgctgagaaggctagaaggagatacagctctacaaggagtttcccatatcattgttgatgaagttcatgagaggacagaagaaagtgacttcttgctgctagttttgaaggacattgtatcgcagaggccaggtcttcaagttattttaatgagtgcaactctaaacgctgagcttttttcagactattttaattcctgccccgttattactataccaggtcgtacatttcctgttgatcaattttttttggaagatgcaattgctgtgacaaggtatgtattacaggatgggagcccatatatgcggtccatgaaacagatttcaaaggaaaagcttaaagcaaggcggaacagaactgcatttgaagaagtggaagaagacctaaggctctcccttcacctccaggatcaggattctgtcaaagatgcagtgccagatcaacagttagattttaagcagctcctggcccgctataaaggggttagcaagtcagtcatcaaaacaatgtccatcatggattttgaaaaggtgaatcttgaattaatagaggccttattagagtggattgtggatggaaagcactcctaccctccaggtgctatacttgtatttttaccaggactagcagaaatcaaaatgctttatgaacagctacagtctaattctcttttcaacaacagacgtagtaatcgatgtgttattcacccacttcattcatctttatccagtgaagagcagcaggctgtgtttgtaaaacctcctgcaggagtaactaagattataatttccaccaacattgctgagacatccataaccatcgatgatgttgtctatgttatcgattctgggaaaatgaaagaaaagagatatgatgccagcaaagggatggaaagtctagaggacacctttgtatctcaagctaatgctctacaaaggaaaggccgagcaggccgtgttgcatctggggtctgcttccatttattcactagccatcactacaatcaccagcttttaaaacaacagctaccagaaatacaaagagtgccattggaacagctgtgtctaagaattaaaattttagagatgtttagtgctcataatctccagtctgtgttctctcggctcattgaacctccacacaccgattctcttcgtgcctcaaaaatacgattacgagacttaggagcattaactccagatgaaagattgacccctcttgggtatcatttggcctctctgcccgtggatgtgagaattggcaaactaatgttgtttgggtctatcttccgctgtttggatcctgctctcaccattgctgccagtttggcttttaagtctccgtttgtatctccctgggataaaaaagaagaagctaaccagaaaaagctggaatttgcattcgcaaacagtgattatctggcccttctacaagcgtataagggatggcagctaagtacaaaagaaggcgtgcgtgcaagttataattactgcagacaaaacttcttgtctggaagagttctgcaggaaatggccagcctcaaacgacaattcacggaactgttatcggatatagggtttgcaagggaagggctcagagcaagggaaattgagaaaagggcccaaggaggagatggtgtcttagatgccacaggagaagaggcaaactcaaatgctgagaaccccaagctgatatcagcaatgctgtgtgctgctttgtatccaaatgtagtgcaggtgaaaagcccagaaggaaaatttcagaagaccagtactggagctgtcagaatgcaaccaaaatcagctgagttgaagtttgtcaccaagaacgatggatatgtacacattcacccttcatcagtgaactatcaggtgagacactttgacagcccctacctgttgtaccacgagaagataaaaactagtcgagtattcatccgagactgcagcatggtgtctgtgtacccgctggtcttgtttggaggaggccaagtgaatgtgcagcttcaaagaggagagttcgttgtctccctggatgatggttggatccgttttgtagctgcttcccatcaggtggctgaactggtaaaggagcttcgttgtgaacttgatcagcttctccaggataaaattaaaaacccaagcattgatctgtgtacgtgtcctcgaggatcccggatcatcagcacaattgtgaaacttgtcaccacacaataaaaagcagtcttagagagtgcttgctactcacctgcttctagctcacctgggaaataacagcagaacctctacctcgaactaaagacctattggggctggccctggtggaggagcccagggcatgaagcccaaggcagctgaggcagtgtatatacccttagggccatttctaacaaagccttggccactcccagcacaatttggagtgtcaagggtgagagcctaaaacccagcttgcctgtctttgtctctgtgattgttctggagtgaattaagttcacctgataactcaaaagtgaatgtataatacaattctgttttaatctgtgtattctttttctcctactttttactggggtgagaggggcatgaagagaaatacgccttttttttttttcttttcctgtcgccaaggctcgactgagagaagtcagaacagagaaggggaaaaaaaacccaaaattatgtgaacaagcaaaattaaaatttcattttaggctattggctactgagtaaacttgacttgtgaggggtttttatttttactcattaaaagtcaacttaaaaaaattgaa

SEQ ID NO: 29689 - DNA, 4024 bp, Homo sapiens
gtggtttagagccaggcgggcgtggtaacacatgcctgtagtctcagctacttggaaggctgaggcaggaggatcacttgagacaatgccagcctggaaaacataatgagtccctgtctctaaaaacaaaacaaaacaaatactgcgatttaccttagaaaaaattaatatataaaaggagaaggataaggaaggacttttaccctgtttcaaagactcaaaggataaataatgtgcccaagatcgcatagctagtaagtggtttagccaattctgtttctaaagtccattttgtttttaccccattcacatgaagattattttaaaagaattcataagtgaatcctgagggcaaagttagagataggacagaggcaagttgcttaaccaatatgggaattggattaaatgctctctaggccctccagttttaaagttctgtgagtctgatttttgacaccatgtaacaccatcacatatgtagtacaatacccaaagaacatcacaatgtatataaattgcactgtaggtaagatgatagaaacaaaaaattagatattcaatttgatcagtgtgataagtttatgataaaattatatgtaggaaatagcaagttcctgtaaatttattacagtattcaaaagtatagccagagttttaacaaacaaggcaatttttatagcattggccattaaatatgaaattgatttatatagttgtagtgactgcccaaaaataaccctttagtgagtgcttttctattattgatttaggtaaaaatctgatattgcttagagctacgctgtctgatatggtagcccctacccatgtttggctgtttatattaattaattaaaattaaaaattcagttcctcagtaacactattcttcacatttcaggtgctcaatagccacatgtagccaggtgttgctgtattggacagcacaggtatagaacatttccatcaacacggaaagttctattggacagtactggtatagagactcttgttgggaagaactggatatgtgctaagcaagagggctttatttcacccagaaaatctttcggtttattcagatgttggaaaactaatgtacagattccacaactcattctggctgattctctgagcagcattctgaataaagtcttctacatccaatcccaacaaatccaacaaaggatcactcaaggccaggagtgcaagaccatccagggcaacataacaagactctgtctctataattaaaaaaaaaaaaaagctgtaatcccagcactttgggagaccaaggcaggtggattcttgagcacaggagtttgaggccagcctgggcaacatggtgaagtcctgtctctacaaaaaaatacaaaaagccgggcttccagacagttccagtccattctgcaagagaggcaatcactccctgcttgggaagaaagagaaaccattcttaacttattgcgtaagcaccaggtggttgtcataagtggtatgactggatgtgggaaaaccacacaaattccgcagtttattctggatgattctctgaatggaccacctgagaaggtagccaacatcatctgtacccaaccccgacgaatctctgcaatctctgttgctgaacgcgttgctaaagaaagagcagagagggtgggtctgaccgtgggataccagattcggttagaaagtgtcaagtcctcagccaccagactgttatactgcaccacgggagtgctgctgagaaggctagaaggagatacagctctacaaggagtttcccatatcattgttgatgaagttcatgagaggacagaagaaagtgacttcttgctgctagttttgaaggacattgtatcgcagaggccaggtcttcaagttattttaatgagtgcaactctaaacgctgagcttttttcagactattttaattcctgccccgttattactataccaggtcgtacatttcctgttgatcaattttttttggaagatgcaattgctgtgacaaggtatgtattacaggatgggagcccatatatgcggtccatgaaacagatttcaaaggaaaagcttaaagcaaggcggaacagaactgcatttgaagaagtggaagaagacctaaggctctcccttcacctccaggatcaggattctgtcaaagatgcagtgccagatcaacagttagattttaagcagctcctggcccgctataaaggggttagcaagtcagtcatcaaaacaatgtccatcatggattttgaaaaggtgaatcttgaattaatagaggccttattagagtggattgtggatggaaagcactcctaccctccaggtgctatacttgtatttttaccaggactagcagaaatcaaaatgctttatgaacagctacagtctaattctcttttcaacaacagacgtagtaatcgatgtgttattcacccacttcattcatctttatccagtgaagagcagcaggctgtgtttgtaaaacctcctgcaggagtaactaagattataatttccaccaacattgctgagacatccataaccatcgatgatgttgtctatgttatcgattctgggaaaatgaaagaaaagagatatgatgccagcaaagggatggaaagtctagaggacacctttgtatctcaagctaatgctctacaaaggaaaggccgagcaggccgtgttgcatctggggtctgcttccatttattcactagccatcactacaatcaccagcttttaaaacaacagctaccagaaatacaaagagtgccattggaacagctgtgtctaagaattaaaattttagagatgtttagtgctcataatctccagtctgtgttctctcggctcattgaacctccacacaccgattctcttcgtgcctcaaaaatacgattacgagacttaggagcattaactccagatgaaagattgacccctcttgggtatcatttggcctctctgcccgtggatgtgagaattggcaaactaatgttgtttgggtctatcttccgctgtttggatcctgctctcaccattgctgccagtttggcttttaagtctccgtttgtatctccctgggataaaaaagaagaagctaaccagaaaaagctggaatttgcattcgcaaacagtgattatctggcccttctacaagcgtataagggatggcagctaagtacaaaagaaggcgtgcgtgcaagttataattactgcagacaaaacttcttgtctggaagagttctgcaggaaatggccagcctcaaacgacaattcacggaactgttatcggatatagggtttgcaagggaagggctcagagcaagggaaattgagaaaagggcccaaggaggagatggtgtcttagatgccacaggagaagaggcaaactcaaatgctgagaaccccaagctgatatcagcaatgctgtgtgctgctttgtatccaaatgtagtgcaggtgaaaagcccagaaggaaaatttcagaagaccagtactggagctgtcagaatgcaaccaaaatcagctgagttgaagtttgtcaccaagaacgatggatatgtacacattcacccttcatcagtgaactatcaggtggctgaactggtaaaggagcttcgttgtgaacttgatcagcttctccaggataaaattaaaaacccagcttgcctgtctttgtctctgtgattgttctggagtgaattaagttcacctgataactcaaaagtgaatgtataatacaattctgttttaatctgtgtattctttttctcctactttttactggggtgagaggggcatgaagagaaatacgccttttttttttttcttttcctgtcgccaaggctcgactgagagaagtcagaacagagaaggggaaaaaaaacccaaaattatgtgaacaagcaaaattaaaatttcattttaggctattggctactgagtaaacttgacttgtgaggggtttttatttttactcattaaaagtcaacttaaaaaaattgaa

SEQ ID NO: 29690 - DNA, 3584 bp, Homo sapiens
gtggtttagagccaggcgggcgtggtaacacatgcctgtagtctcagctacttggaaggctgaggcaggaggatcacttgagacaatgccagcctggaaaacataatgagtccctgtctctaaaaacaaaacaaaacaaatactgcgatttaccttagaaaaaattaatatataaaaggagaaggataaggaaggacttttaccctgtttcaaagactcaaaggataaataatgtgcccaagatcgcatagctagtaagtggtttagccaattctgtttctaaagtccattttgtttttaccccattcacatgaagattattttaaaagaattcataagtgaatcctgagggcaaagttagagataggacagaggcaagttgcttaaccaatatgggaattggattaaatgctctctaggccctccagttttaaagttctgtgagtctgatttttgacaccatgtaacaccatcacatatgtagtacaatacccaaagaacatcacaatgtatataaattgcactgtaggtaagatgatagaaacaaaaaattagatattcaatttgatcagtgtgataagtttatgataaaattatatgtaggaaatagcaagttcctgtaaatttattacagtattcaaaagtatagccagagttttaacaaacaaggcaatttttatagcattggccattaaatatgaaattgatttatatagttgtagtgactgcccaaaaataaccctttagtgagtgcttttctattattgatttaggtaaaaatctgatattgcttagagctacgctgtctgatatggtagcccctacccatgtttggctgtttatattaattaattaaaattaaaaattcagttcctcagtaacactattcttcacatttcaggtgctcaatagccacatgtagccaggtgttgctgtattggacagcacaggtatagaacatttccatcaacacggaaagttctattggacagtactggtatagagactcttgttgggaagaactggatatgtgctaagcaagagggctttatttcacccagaaaatctttcggtttattcagatgttggaaaactaatgtacagattccacaactcattctggctgattctctgagcagcattctgaataaagtcttctacatccaatcccaacaaatccaacaaaggatcactcaaggccaggagtgcaagaccatccagggcaacataacaagactctgtctctataattaaaaaaaaaaaaaagctgtaatcccagcactttgggagaccaaggcaggtggattcttgagcacaggagtttgaggccagcctgggcaacatggtgaagtcctgtctctacaaaaaaatacaaaaagccgggcttccagacagttccagtccattctgcaagagaggcaatcactccctgcttgggaagaaagagaaaccattcttaacttattgcgtaagcaccaggtggttgtcataagtggtatgactggatgtgggaaaaccacacaaattccgcagtttattctggatgattctctgaatggaccacctgagaaggtagccaacatcatctgtacccaaccccgacgaatctctgcaatctctgttgctgaacgcgttgctaaagaaagagcagagagggtgggtctgaccgtgggataccagattcggttagaaagtgtcaagtcctcagccaccagactgttatactgcaccacgggagtgctgctgagaaggctagaaggagatacagctctacaaggagtttcccatatcattgttgatgaagttcatgagaggacagaagaaagtgacttcttgctgctagttttgaaggacattgtatcgcagaggccaggtcttcaagttattttaatgagtgcaactctaaacgctgagcttttttcagactattttaattcctgccccgttattactataccaggtcgtacatttcctgttgatcaattttttttggaagatgcaattgctgtgacaaggtatgtattacaggatgggagcccatatatgcggtccatgaaacagatttcaaaggaaaagcttaaagcaaggcggaacagaactgcatttgaagaagtggaagaagacctaaggctctcccttcacctccaggatcaggattctgtcaaagatgcagtgccagatcaacagttagattttaagcagctcctggcccgctataaaggggttagcaagtcagtcatcaaaacaatgtccatcatggattttgaaaaggtgaatcttgaattaatagaggccttattagagtggattgtggatggaaagcactcctaccctccaggtgctatacttgtatttttaccaggactagcagaaatcaaaatgctttatgaacagctacagtctaattctcttttcaacaacagacgtagtaatcgatgtgttattcacccacttcattcatctttatccagtgaagagcagcaggctgtgtttgtaaaacctcctgcaggagtaactaagattataatttccaccaacattgctgagacatccataaccatcgatgatgttgtctatgttatcgattctgggaaaatgaaagaaaagagatatgatgccagcaaagggatggaaagtctagaggacacctttgtatctcaagctaatgctctacaaaggaaaggccgagcaggccgtgttgcatctggggtctgcttccatttattcactagccatcactacaatcaccagcttttaaaacaacagctaccagaaatacaaagagtgccattggaacagctgtgtctaagaattaaaattttagagatgtttagtgctcataatctccagtctgtgttctctcggctcattgaacctccacacaccgattctcttcgtgcctcaaaaatacgattacgagacttaggagcattaactccagatgaaagattgacccctcttgggtatcatttggcctctctgcccgtggatgtgagaattggcaaactaatgttgtttgggtctatcttccgctgtttggatcctgctctcaccattgctgccagtttggcttttaagtctccgtttgtatctccctgggataaaaaagaagaagctaaccagaaaaagctggaatttgcattcgcaaacagtgattatctggcccttctacaagcgtataagggatggcagctaagtacaaaagaaggcgtgcgtgcaagttataattactgcagacaaaacttcttgtctggaagagttctgcaggaaaagagatgagccagcaagaccataatgaaggagaaagaggaaacattctgctgagttccactgagagcacgaaccactctaggcctgagtaaggaactgagaggacaggagcaaaaatgcaagtaggaaaagctaggtagtagacagtgccgcagcacttggagttggaattccagtcaaaacaaacagcattttttgctgtcctaagaatttcgtggaaaatcaggcctacccaaaatccaatgagagtgtttaaaattgtaatctagagttaaataaatgatccttggatttattgaatttttgcatttctg

SEQ ID NO: 29691 - DNA, 1029 bp, Homo sapiens
aaatttggggagtcattaataggcagtatttaaatccgtgggactggggggttgttccctttttgttgccagtgacatcactgtcatcatctgaggttttttgttacaggtgagacactttgacagcccctacctgttgtaccacgagaagataaaaactagtcgagtattcatccgagactgcagcatggtgtctgtgtacccgctggtcttgtttggaggaggccaagtgaatgtgcagcttcaaagaggagagttcgttgtctccctggatgatggttggatccgttttgtagctgcttcccatcaggtggctgaactggtaaaggagcttcgttgtgaacttgatcagcttctccaggataaaattaaaaacccaagcattgatctgtgtacgtgtcctcgaggatcccggatcatcagcacaattgtgaaacttgtcaccacacaataaaaagcagtcttagagagtgcttgctactcacctgcttctagctcacctgggaaataacagcagaacctctacctcgaactaaagacctattggggctggccctggtggaggagcccagggcatgaagcccaaggcagctgaggcagtgtatatacccttagggccatttctaacaaagccttggccactcccagcacaatttggagtgtcaagggtgagagcctaaaacccagcttgcctgtctttgtctctgtgattgttctggagtgaattaagttcacctgataactcaaaagtgaatgtataatacaattctgttttaatctgtgtattctttttctcctactttttactggggtgagaggggcatgaagagaaatacgccttttttttttttcttttcctgtcgccaaggctcgactgagagaagtcagaacagagaaggggaaaaaaaacccaaaattatgtgaacaagcaaaattaaaatttcattttaggctattggctactgagtaaacttgacttgtgaggggtttttatttttactcattaaaagtcaacttaaaaaaattgaa

SEQ ID NO: 29692 - DNA, 1069 bp, Homo sapiens
tgccaagagatactttctatgagaatatatatattatatgtctatttttacaaatacttgttgtttaggtgaaaagcccagaaggaaaatttcagaagaccagtactggagctgtcagaatgcaaccaaaatcagctgagttgaagtttgtcaccaagaacgatggatatgtacacattcacccttcatcagtgaactatcaggtgagacactttgacagcccctacctgttgtaccacgagaagatagtcttgtttggaggaggccaagtgaatgtgcagcttcaaagaggagagttcgttgtctccctggatgatggttggatccgttttgtagctgcttcccatcaggtggctgaactggtaaaggagcttcgttgtgaacttgatcagcttctccaggataaaattaaaaacccaagcattgatctgtgtacgtgtcctcgaggatcccggatcatcagcacaattgtgaaacttgtcaccacacaataaaaagcagtcttagagagtgcttgctactcacctgcttctagctcacctgggaaataacagcagaacctctacctcgaactaaagacctattggggctggccctggtggaggagcccagggcatgaagcccaaggcagctgaggcagtgtatatacccttagggccatttctaacaaagccttggccactcccagcacaatttggagtgtcaagggtgagagcctaaaacccagcttgcctgtctttgtctctgtgattgttctggagtgaattaagttcacctgataactcaaaagtgaatgtataatacaattctgttttaatctgtgtattctttttctcctactttttactggggtgagaggggcatgaagagaaatacgccttttttttttttcttttcctgtcgccaaggctcgactgagagaagtcagaacagagaaggggaaaaaaaacccaaaattatgtgaacaagcaaaattaaaatttcattttaggctattggctactgagtaaacttgacttgtgaggggtttttatttttactcattaaaagtcaacttaaaaaaattgaa

SEQ ID NO: 29693 - DNA, 2585 bp, Homo sapiens
gtggtttagagccaggcgggcgtggtaacacatgcctgtagtctcagctacttggaaggctgaggcaggaggatcacttgagacaatgccagcctggaaaacataatgagtccctgtctctaaaaacaaaacaaaacaaatactgcgatttaccttagaaaaaattaatatataaaaggagaaggataaggaaggacttttaccctgtttcaaagactcaaaggataaataatgtgcccaagatcgcatagctagtaagtggtttagccaattctgtttctaaagtccattttgtttttaccccattcacatgaagattattttaaaagaattcataagtgaatcctgagggcaaagttagagataggacagaggcaagttgcttaaccaatatgggaattggattaaatgctctctaggccctccagttttaaagttctgtgagtctgatttttgacaccatgtaacaccatcacatatgtagtacaatacccaaagaacatcacaatgtatataaattgcactgtaggtaagatgatagaaacaaaaaattagatattcaatttgatcagtgtgataagtttatgataaaattatatgtaggaaatagcaagttcctgtaaatttattacagtattcaaaagtatagccagagttttaacaaacaaggcaatttttatagcattggccattaaatatgaaattgatttatatagttgtagtgactgcccaaaaataaccctttagtgagtgcttttctattattgatttaggtaaaaatctgatattgcttagagctacgctgtctgatatggtagcccctacccatgtttggctgtttatattaattaattaaaattaaaaattcagttcctcagtaacactattcttcacatttcaggtgctcaatagccacatgtagccaggtgttgctgtattggacagcacaggtatagaacatttccatcaacacggaaagttctattggacagtactggtatagagactcttgttgggaagaactggatatgtgctaagcaagagggctttatttcacccagaaaatctttcggtttattcagatgttggaaaactaatgtacagattccacaactcattctggctgattctctgagcagcattctgaataaagtcttctacatccaatcccaacaaatccaacaaaggatcactcaaggccaggagtgcaagaccatccagggcaacataacaagactctgtctctataattaaaaaaaaaaaaaagctgtaatcccagcactttgggagaccaaggcaggtggattcttgagcacaggagtttgaggccagcctgggcaacatggtgaagtcctgtctctacaaaaaaatacaaaaagccgggcttccagacagttccagtccattctgcaagagaggcaatcactccctgcttgggaagaaagagaaaccattcttaacttattgcgtaagcaccaggtggttgtcataagtggtatgactggatgtgggaaaaccacacaaattccgcagtttattctggatgattctctgaatggaccacctgagaaggtagccaacatcatctgtacccaaccccgacgaatctctgcaatctctgttgctgaacgcgttgctaaagaaagagcagagagggtgggtctgaccgtgggataccagattcggttagaaagtgtcaagtcctcagccaccagactgttatactgcaccacgggagtgctgctgagaaggctagaaggagatacagctctacaaggagtttcccatatcattgttgatgaagttcatgagaggacagaagaaaggtaaaacaaagactttcccagggaacacacactcacctgaattgaaggcatggcagaaaaaattgttttctagttccaattcagtttcatgcagctagtaatggtaatttgccacaaggaaggcctatgttagagaagagcaactgctttcttgatctccagggtctgtaacactaaaaaggacagcacatgctcatcacttattagatggagtcatcctgttaggttagaaggtatacttcacaccatcctgggcattatgctaagttgaataccgtacttagtagaaataacagatgtcatgcatgctgtggctgaatgtatcttcttccttgtttatttggccattcagtcctgacattgattcatgtatttattgagcctgcattaaatgcccaagtgatatattagttgctggggatacagtgatgaacaagcatgtatggctccccctcatctcttacagtccagtagaaaaaacaaataatgaacaagtaaacaagcaaatgattgtaaattggaataagcactatgaaggaataaacggcatgctgtgtttggagggagagacccatagatgctcaaagatcatatctctgtaagatgacaatttaaattcaaaactgaagtatggccgggcgcaatggctcacacccataatccctgcactttgggaggccaaggtgggaggatcgcttgagctcaggagttggagccccacctgggcaacatagtgagaccatgtttccacgaaaagta

SEQ ID NO: 29694 - DNA, 1441 bp, Homo sapiens
agaatgtacttacacaaccccagatggtacaacctacaacacacctaggctgtatgatgtagccaattgctcctagactacaaatctatacagcatgttgctgtactgaatactctaagcaattataacacaatgacctagcaacagtaacataagcaaaggagagtcacgcccaaaatggaaacccaaagccaaagtaccccttcagactctacatatgacttctgagaatcaagagaaagtgaaagctcttctccgagacctgcaagaacaagatgctgatgctggatctgaaagaggcctttctggggaggaggaagatgatgagcctgattgctgtaacgatgagcggtactggccagctggacaggaaccttccctcgttcccgacttggatcctttggaatatgctggcttagcctcagtggagccttatgttccagaatttacagtctccccatttgcagtgcaaaaactttccaggtatggtttcaatactgaacgctgtcaagcggtcctgaggatgtgtgatggagatgtgggagcatcactagagcatctccttacccagtgtttttcagagacatttggagagaggatgaagatctctgaggcagtcaaccagataagcttggatgagtgtatggaacagcgacaggaagaggcatttgctctcaagtccatctgtggagaaaaatttatagaaagaattcagaacagagtctggaccattgggttagaactggagtatctgacaagtagattccgcaaatccaagccaaaagaaagtaccaaaaatgtacaagagaattcacttgaaatctgtaaattttacctcaaaggaaattgtaaatttggatcaaaatgcagattcaaacatgaagtgcccccaaatcaaattgttggaagaatagaaagaagtgtagatgattctcatcttaatgctattgaagatgcatcttttttatatgaacttgaaattcgattttctaaagaccacaaatatccctaccaagctccgctcgtggcattttattccaccaatgagaacctacctctggcttgtcgtttacatatttctgagtttctttatgacaaggccttgacatttgcggaaacttcggaacctgtcgtatattctttgataacccttttagaggaagagtcggaaatagtcaagttactaacgaatacccaccacaagtatagtgaccctcctgtgaactttctgccagtaccctctaggaccagaataaataatcctgcctgtcataaaacagtgattccaaataattcttttgtttctaatcaaattccagaagttgaaaaagcatcagaatctgaggagtcagatgaggatgacggtcctgcacctgttatagtagagaatgaaagctatgtgaaccttaagaaaaagatttccaaaagatatgactggcag

SEQ ID NO: 29695 - DNA, 845 bp, Homo sapiens
agaatgtacttacacaaccccagatggtacaacctacaacacacctaggctgtatgatgtagccaattgctcctagactacaaatctatacagcatgttgctgtactgaatactctaagcaattataacacaatgacctagcaacagtaacataagcaaaggagagtcacgcccaaaatggaaacccaaagccaaagtaccccttcagactctacatatgacttctgagaatcaagagaaagtgaaagctcttctccgagacctgcaagaacaagatgctgatgctggatctgaaagaggcctttctggggaggaggaagatgatgagcctgattgctgtaacgatgagcggtactggccagctggacaggaaccttccctcgttcccgacttggatcctttggaatatgctggcttagcctcagtggagccttatgttccagaatttacagtctccccatttgcagtgcaaaaactttccaggtatggtttcaatactgaacgctgtcaagcggtcctgaggatgtgtgatggagatgtgggagcatcactagagcatctccttacccagtgtttttcagagacatttggagagaggatgaagatctctgaggcagtcaaccagataagcttggatgagtgtatggaacagcgacaggaagaggcatttgctctcaagtccatctgtggctgagagaagtcagaacagagaaggggaaaaaaaacccaaaattatgtgaacaagcaaaattaaaatttcattttaggctattggctactgagtaaacttgacttgtgaggggtttttatttttactcattaaaagtcaacttaaaaaaattgaa

SEQ ID NO: 29696 - DNA, 475 bp, Homo sapiens
ggcctccagtagaatatgggatgatggagatgacttttgtatcttcagtgaatcaaggcgcccttccagacctagcaacagtaacataagcaaaggagagtcacgcccaaaatggaaacccaaagccaaagtaccccttcagactctacatatgacttctgagaatcaagagaaagtgaaagctcttctccgagacctgcaagaacaagatgctgatgctggatctgaaagaggcctttctggggaggaggaagatgatgagcctgattgctgtaacgatgagcggtactggccagctggacaggaaccttccctcgttcctgagagaagtcagaacagagaaggggaaaaaaaacccaaaattatgtgaacaagcaaaattaaaatttcattttaggctattggctactgagtaaacttgacttgtgaggggtttttatttttactcattaaaagtcaacttaaaaaaattgaa

SEQ ID NO: 29697 - DNA, 683 bp, Homo sapiens
ggcctccagtagaatatgggatgatggagatgacttttgtatcttcagtgaatcaaggcgcccttccagacctagcaacagtaacataagcaaaggagagtcacgcccaaaatggaaacccaaagccaaagtaccccttcagactctacatatgacttctgagaatcaagagaaagtgaaagctcttctccgagacctgcaagaacaagatgctgatgctggatctgagtaaattgttttatttgagtcaattattatattaaggaaaacatactggcagtgtgaaggtcctgtgcatctttggaatgctgtgtcagtactgattctattgtggccatttaattagttgaaagtgagccaagagtaatacaagaataattattcagccacaattttagagtgagtttgttttgcaacatccatgggattgcctttttatctttatttttttccagggcagtgctcatatggattcagtaactgatttatctgtaaccttccagataaacccttgtaatgaacaagtagaagtagtgttgaaggagcaaatattgactcggtcaggtgcagtcttaggatttgcttgtcatgactgtctgcctaagagaaagcttttactcttaaatcttattcgtttcccactctactgcatttcggctcttttgctttggatttcagttgga

SEQ ID NO: 29698 - DNA, 259 bp, Homo sapiens
caagcaaatgattgtaaattggaataagcactatgaaggaataaacggcatgctgtgtttggagggagagacccatagatgctcaaagatcatatctctgtaagatgacaatttaaattcaaaactgaagtatggccgggcgcaatggctcacacccataatccctgcactttgggaggccaaggtgggaggatcgcttgagctcaggagttggagccccacctgggcaacatagtgagaccatgtttccacgaaaagt

SEQ ID NO: 29699 - DNA, 371 bp, Homo sapiens
cagaagtcatctagtaaagactgttttgctcttgaacttgggacataatccatttaaccaaataaggagcagacagattgagaactgttttcattattcactgttttttaatgctttttatgaaaatcttaacattgtgatatgaagtagaaaggcttttattactgtccctggcaagaaactatgtttagtatggtttcctattaaatggaactgctggtgtttccaatattttttatcactatccattcaaaatggctttccagtaatgtttcctttttttgaaaattttattaatgatttatattgccctttcatgtgtaagtcctcagccaccagactgttatactgcaccacgggagtgctgctga

SEQ ID NO: 29700 - DNA, 370 bp, Homo sapiens
caatttctgttaccagaacttttcttcttgatacttttaagaccacagaacaaataggacgttagcatgacaagctttaagagaattttatatatataaactatttcaagatggttgaatgggtgttctcaggctttctattttgtctccttgtttttctaggtcgtacatttcctgttgatcaattttttttggaagatgcaattgctgtgacaaggtaaggaagatattaattaagattcagtgaaaggacctggcatggtggttcatccctgtaattctagcactttggaaggcaaaggtgggaggatcttttggggccagttcaagaccagcttgggcaacatattgggacccccatctattgaga

SEQ ID NO: 29701 - DNA, 383 bp, Homo sapiens
gccttggcctcccaaagtgctgggattacaggcgtgagccactgcgcctggcccgaatcttttctttagatgagatgtgatagaggcacttttttacaatggacctcatttagtctattacaaaatgaaaatgtatttagggtttttgctcctaatggagttaaaattagtaccagaaatctaaataatggtaatcataacttgggtatttccctccaataacctatcctgcctgttcctccaagcactgcttatattgtagctttcattttaggtggctgaactggtaaaggagcttcgttgtgaacttgatcagcttctccaggataaaattaaaaacccaagcattgatctgtgtacgtgtcctcgaggatcccggatca

SEQ ID NO: 29702 - DNA, 4574 bp, Homo sapiens
tgggtgcctttttccgccgcgcgccaccagaatgtccctgtcttgaggtctaatggcggacgccagtatgttggagttggtggtggcttaagttttgaagggaggtagcatccgttggatatccacaccatccttctcgctgcaggctttcttggactccgtactgttggtgtaaccaaggcctggaggtctgggtggctcaggtttcctgcagccatgtttctgtacaacttaaccttgcagagagccactggcatcagctttgccattcatggaaacttttctggaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggtggcaccaaagactacattgtagttggcagtgactctggtcgaattgttattttggaataccagccatctaagaatatgtttgagaagattcaccaagaaacctttggcaagagtggatgccgtcgcatcgttcctggccagttcttagctgtggatcccaaagggcgagccgttatgattagtgccattgagaaacagaaattggtgtatattttgaacagagatgctgcagcccgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaactttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactattggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtata

SEQ ID NO: 29703 - DNA, 4549 bp, Homo sapiens
ctcactatagggctcgagcggccgcccgggcaggtcgccagtatgttggagttggtggtggcttaagttttgaagggaggtagcatccgttggatatccacaccatccttctcgctgcaggctttcttggactccgtactgttggtgtaaccaaggcctggaggtctgggtggctcaggtttcctgcagccatgtttctgtacaacttaaccttgcagagagccactggcatcagctttgccattcatggaaacttttctggaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggtggcaccaaagactacattgtagttggcagtgactctggtcgaattgttattttggaataccagccatctaagaatatgtttgagaagattcaccaagaaacctttggcaagagtggatgccgtcgcatcgttcctggccagttcttagctgtggatcccaaagggcgagccgttatgattagtgccattgagaaacagaaattggtgtatattttgaacagagatgctgcagcccgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaactttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactattggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtata

SEQ ID NO: 29704 - DNA, 1180 bp, Homo sapiens
tgggtgcctttttccgccgcgcgccaccagaatgtccctgtcttgaggtctaatggcggacgccagtatgttggagttggtggtggcttaagttttgaagggaggtagcatccgttggatatccacaccatccttctcgctgcaggctttcttggactccgtactgttggtgtaaccaaggcctggaggtctgggtggctcaggtttcctgcagccatgtttctgtacaacttaaccttgcagagagccactggcatcagctttgccattcatggaaacttttctggaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggtggcaccaaagactacattgtagttggcagtgactctggtcgaattgttattttggaataccagccatctaagaatatgtttgagaagattcaccaagaaacctttggcaagagtggatgccgtcgcatcgttcctggccagttcttagctgtggatcccaaagggcgagccgttatgattagtgccattgagaaacagaaattggtgtatattttgaacagagatgctgcagcccgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgacaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggt

SEQ ID NO: 29705 - DNA, 825 bp, Homo sapiens
tgggtgcctttttccgccgcgcgccaccagaatgtccctgtcttgaggtctaatggcggacgccagtatgttggagttggtggtggcttaagttttgaagggaggtagcatccgttggatatccacaccatccttctcgctgcagggtaaaaaaacagcctggagacttccccgggcccggggaggcggagaccggccatatggaagggggacccgagactttggcgggggtcacgggcagtctaggcccgagaggctggggaccaggaggaggtaccgagggatggttgaggcgccaaaacggcttcctgcagttatctctcgcttccatccacagtgtgggaacatattctgtctcaaaatagggctcgtggagattgcttttaacttctggggactctgagacgggggaggtgtgacaagcagcgggaggcatggatgtctccctctgggtagagtaaatggtacaccgaggggaagatagaaagatggagcgtgttaaaagcgtaaataacggaaacagtctttagagccaagactccggtttgaatttgtattttggtagttgggcaacttgtctcctcctctgaacctctattttctcgtttgcgtaatggaggacagagtttaaatgcgatgatgtttccttggaggatggagaagatgcagtgagcaatcatacaagctttttgtaataatggtaaacagacgtgggggaagttttttttgttttgttttgttttgtttttgtgacggagtcacagtctgtcgcccagactggagagcagtggcgcgatctcggctcactgccatctctgcctcccg

SEQ ID NO: 29706 - DNA, 1268 bp, Homo sapiens
tgggtgcctttttccgccgcgcgccaccagaatgtccctgtcttgaggtctaatggcggacgccagtatgttggagttggtggtggcttaagttttgaagggaggtagcatccgttggatatccacaccatccttctcgctgcaggctttcttggactccgtactgttggtgtaaccaaggcctggaggtctgggtggctcaggtttcctgcagccatgtttctgtacaacttaaccttgcagagagccactggcatcagctttgccattcatggaaacttttctggaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggtggcaccaaagactacattgtagttggcagtgactctggtcgaattgttattttggaataccagccatctaagaatatgtttgagaagattcaccaagaaacctttggcaagagtggatgccgtcgcatcgttcctggccagttcttagctgtggatcccaaagggcgagccgttatgattagtgccattgagaaacagaaattggtgtatattttgaacagagatgctgcagcccgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtata

SEQ ID NO: 29707 - DNA, 394 bp, Homo sapiens
ctcctgggttcaagcgattctcctgccttagcctcccgagtagctgggattacaggcatgtgccaccacgcctggctaatttttgtatttttagtagagacggggtttcaccatggtggccaggctgggttctggttgtttatgatctttattttttggtgatctaggaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggtggcaccaaagactacattgtagttggcagtgactctggtcgaattgttattttggaataccagccatctaagaatatgttt

SEQ ID NO: 29708 - DNA, 6791 bp, Homo sapiens
gctgccgcgggcggtgggcggggatcccccgggggtgcaaccttgctccacctgtgctgccctcggcgggcctggctggccccgcgcagagcggcggcggcgctcgctgtcactgccggaggtgagagcgcagcagtagcttcagcctgtcttgggcttggtccagattcgctcctctggggctacgtcccggggaagaggaagcgaggattttgctggggtggggctgtacctcttaacagcaggtgcgcgcgcgagggtgtgaacgtgtgtgtgtgtgtgtgtctgtgtgtgtgtgtgtaagacctgcgatgacgacgaggaggaacaagtgggacggcgagtgatgctcagggccagcagcaacgcatggggcgagcttcagtgtcgccagcagtgaccacagttcttgaggccaaatctggctcctaaaaaacatcaaaggaagcttgcaccaaactctcttcagggccgcctcagaagcctgccatcacccactgtgtggtgcacaatggcgccccccacaggtgtgctctcttcattgctgctgctggtgacaattgcaggttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgccctttctaggcaaagattggggcctagaggagatgtctgagtacgcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtactaaaagaccggtttttgaaggcacaaaacaaaaactttgctcttttaactgagatgcttgttaatagaaataaaggctgggtaaaactctaaggtatatacttaaaagagttttgagtttttgtagctggcacaatctcatattaaagatgaacaacgatttctatctgtagaaccttagagaaggtgaatgaaacaaggttttaaaaagggatgatttctgtcttagccgctgtgattgcctctaaggaacagcattctaaacacggtttctcttgtaggacctgcagtcagatggctgtgtatgttaaaatagcttgtctaagaggcacgggccatctgtggaggtacggagtcttgcatgtagcaagctttctgtgctgacggcaacactcgcacagtgccaagccctcctggtttttaattctgtgctatgtcaatggcagttttcatctctctcaagaaagcagctgttggccattcaagagctaaggaagaatcgtattctaaggactgaggcaatagaaaggggaggaggagcttaatgccgtgcaggttgaaggtagcattgtaacattatcttttctttctctaagaaaaactacactgactcctctcggtgttgtttagcagtatagttctctaatgtaaacggatccccagtttacattaaatgcaatagaagtgattaattcattaagcatttattatgttctgtaggctgtgcgtttggactgccatagatagggataacgactcagcaattgtgtatatattccaaaactctgaaatacagtcagtcttaacttggatggcgtggttatgatactctggtccccgacaggtactttccaaaataacttgacatagatgtattcacttcatatgtttaaaaatacatttaagtttttctaccgaataaatcttatttcaaacatgaaagacaattaaaacattcccacccacaaagcagtactcccgagcaattaactggagttaattgtagcctgctacgttgactggttcagggtagttccccatccacccttggtcctgaggctggtggccttggtggtgcccttggcattttttgtgggaagattagaatgagagatagaaccagtgttgtggtaccaagtgtgagcacacctaaacaatatcctgttgcacaatgcttttttaacacatgggaaaactaggaatgcattgctgatgaagaagcaaggtatttaaacaccagggcaggagtgccagagaaaatgtttccccatgggttcttaaaaaaaattcagcttttaggtgcttttgtcatctcccggagtattcatcctcatgggaccatcttatttttacttattgtaatttactggggaaaggcagaactaaaaagtgtgtcattttatttttaaaataattgctttgcttatgcctacactttctgtataactagccaattcaatactgtctatagtgttagaaggaaaatgtgatttttttttttaaccagtattgagcttcataagcctagaatctgccttatcaggtgaccagggttatggttgtttgcatgcaaatgtgaatttctggcataggggacagcagcccaaatgtaaagtcatcgggcgtaatgaggaagaagggagtgaacatttaccgctttatgtacataacatatgcagtttacatactcatttgatccttataatcaaccttgaagaggagatactatcattcttatgttgcagatagccctctgaaggcccagagaggttaagtaacttcccagaggtcatggccaagaagtagtggctccaagaactgaatgcaaattttttaaactgtagagttctgctttccactaaacaaagaactcctgccttgatggatggagggcaaattctggtggaacttttgggccacctgaaagttctattcccaggactaagaggaatttcttttaatggatccagagagccaaggtcagagggagagatggcctgcatagtctcctgtggatcacacccgggccacccctccctctaggtttacagtggacttcttctgcccctcctccttttctgtccttggccatctcagcctggcctctctgatccttccatcacagaaggatcttgaatctctgggaaatcaaacatcacagtagtgatcagaaagtgagtcctgtcttgtcaccccatttctcatcagaacaaagcacgagatggaatgaccaaccagcattcttcatggtggactgcttatcattgaggatctttgggagataaagcacgctaagagctctggacagagaaaaacaggccctagaatatgggagtgggtgtttgtagggctcataggctaacaagcactttagttgctggtttacattcaatgaaggaggattcatacccatggcattacaaggctaagcatgtgtatgactaaggaactatctgaaaaacatgcagcaaggtaagaaaatgtaccactcaacaagccagtgatgccaccttttgtgcgcggggaggagagtgactaccattgttttttgtgtgacaaagctatcatggactattttaatcttggttttattgcttaaaatatattatttttccctatgtgttgacaaggtatttctaatatcacactattaaatatatgcactaatctaaataaaggtgtctgtattttctgtaatgcttatttttagggggaaatttgttttctttatgcttcagggtagagggatttcccttgagtataggtcagcaaactgtggcctgcagcctgtgtgtgcacgccccatgagccgaaaagtgggtcttatgttttcaaatggttaaaaataaataaaaaaatttgaaacatgtgaactatatgacattcagatttgtgttcataaataaagttttattggaacatatcc

SEQ ID NO: 29709 - DNA, 3957 bp, Homo sapiens
gctgccgcgggcggtgggcggggatcccccgggggtgcaaccttgctccacctgtgctgccctcggcgggcctggctggccccgcgcagagcggcggcggcgctcgctgtcactgccggaggtgagagcgcagcagtagcttcagcctgtcttgggcttggtccagattcgctcctctggggctacgtcccggggaagaggaagcgaggattttgctggggtggggctgtacctcttaacagcaggtgcgcgcgcgagggtgtgaacgtgtgtgtgtgtgtgtgtctgtgtgtgtgtgtgtaagacctgcgatgacgacgaggaggaacaagtgggacggcgagtgatgctcagggccagcagcaacgcatggggcgagcttcagtgtcgccagcagtgaccacagttcttgaggccaaatctggctcctaaaaaacatcaaaggaagcttgcaccaaactctcttcagggccgcctcagaagcctgccatcacccactgtgtggtgcacaatggcgccccccacaggtgtgctctcttcattgctgctgctggtgacaattgcaggttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgccctttctaggcaaagattggggcctagaggagatgtctgagtacgcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtactaaaagaccggtttttgaaggcacaaaacaaaaactttgctcttttaactgagatgcttgttaatagaaataaaggctgggtaaaactcta

SEQ ID NO: 29710 - DNA, 426 bp, Homo sapiens
  misc_feature (42)..(42): n is a, c, g, or t
  misc_feature (51)..(51): n is a, c, g, or t
  misc_feature (54)..(54): n is a, c, g, or t
tttactccatcaaaacatccaaataaaaatatgtagactccnccaccctantcnccatctgctatagggttctaattcccccacagacatcccatcacagtgctttcccccatgacgggggactcctgagctggactccatccctcccctaccagaaaagcacaggtgctgtggcatgagttcaaccacctgaaattccctgatcttcagagtaataattctaaaatagggcaataatacccctgtcagtgttcttggaagaacttctcattacttgaggccccagaaatgcaaacactcctccggttttccagcatgctgtcaaccctggcatcagagctcttcctgccgtgggcactggtaattgacttactggagaaagtcaagcttttaagtcccaggaataaaggattcctatttccttaa

SEQ ID NO: 29711 - DNA, 1241 bp, Homo sapiens
ttgatctggccactccacaatgtatacttatatcaaaacatcatgctgtacaccataaatatatacaaattttgtcagttaaaaaaattaaaaagacattgaaaagaagcattaaaaagttataattttatatgctggcaatgaataatctgcaaatgaaataaaggaaaacctttcatttacattattatcaaaaataataaaacatttataaatacatttaaccaaggatcactgaaacccacaaaacattaccgaaaggaattaaagaagacctacataatgaaaaggcatccactattcatcttaaaatacttaatattgttaagatggcagtattactcaaagcactttatagagtcaatggaatctctgtaaaaatctcagcagctttttttaatggaaaatctgatattgaaattattattgaattgcaggacaactgaagagccgtaactatctcaaaaaaagaaaaacagtgttggaggactcatatgtcccaattttaaaacttactacagagctataagaaccaaaacagtatagtactgatgtaaggatagacacgtaagtcaatggaaaaggatcgagcgtccagaaataaactcacacatctatgtcctattaatatttgaaagggtgctaaaaccattcaatgagaaaagaagagtctcttaagcacatggtgcaaggatatctggatatccgtatccaaaagagtgaaactagacctctacctcagaccatatataaaaattaactataacatggttcaaagacctaaatgtaggagttaaaactatgaaacatgtagaagaaaacatgggagaaatcttcatgaccttgaattcagtaatggattcttagatatgacaccaaaagcatgagcaacagaagaaaaaaaaggtaaattgtactttatcacaattaaaaatttcaaaggatactctcaagaaattgaagaggcaatcgacagaataagaaaaaatatttgcaaatcacatatctggtaagtgtcttgaatatataaataactcatatcttagcaacaaaaagacagcctaatttttttaaatgtgcaaaagacttgaatagatatttctccagagaagatatacttggctgccaagcacatgaaaagctgctcaacattattagttatgcaaatgactgggaaatgcaaatcggaaaccccagtgaggtacagcttcacacctactaggatggttgtaataaaaaaa

SEQ ID NO: 29712 - DNA, 382 bp, Homo sapiens
  misc_feature (27)..(27): n is a, c, g, or t
tttcgagctggagagcaacggcacatnctcggctcactgcaaactccgcctcctgggttcaagtgattctcctgcttcagcctccggaatagctgggattacagaaatgcgtaaatggcgacagtagagccagccttcatgaatccagaaatgtgagccacattttgaggatagcagagtcactgcagaagcctggatccttgcataaccttgtcgagtgggaaaatctacccatacttgaccaaccacctaactgggggctctacatctgaaagaaatgattttttatcttatttaagccactgtagttaggagtcagtttattacaggacattgcctggtgttccaacaaataaactaccttatttgtttcaataaataa

SEQ ID NO: 29713 - DNA, 349 bp, Homo sapiens
tagcttaatgtcacacaactacttggttgctcactgtaaattttctctctcctcacttcccacctccatagaaatgcgtaaatggcgacagtagagccagccttcatgaatccagaaatgtgagccacattttgaggatagcagagtcactgcagaagcctggatccttgcataaccttgtcgagtgggaaaatctacccatacttgaccaaccacctaactgggggctctacatctgaaagaaatgattttttatcttatttaagccactgtagttaggagtcagtttattacaggacattgcctggtgttccaacaaataaactaccttatttgtttcaataaataa

SEQ ID NO: 29714 - DNA, 1009 bp, Homo sapiens
gtaggagatgagactatttcaccccaaaatatggctgtaggtggccagaatgtgtaccccaaatatgcctctttaaaataaggatcactttgagctgattatttggggagacagtagacacaggagaagctctgaaaacagagtagaagttaagcttttgtaagagaaatttgcatctataaaggaaatctccatcgtaagggtgtctcatctctgtagaagaaaaagaatgagtctaagttactaaaaactcttatcaatagagaaggcaacttaaacacaagtaaggttttttttttgtatagttacccttgtttaaggtgcttttcctccctctaactgggtaggaactttctttgtttcagagaatagtatttaagcttgaagtcaaagctatgatacttctgagatttattcaaaagctttgagatatttcctgtattatttcatttatgttgctataaaggaatacctgaggctgggtaattcataaagaaaagaggtttgtttggctcacagttctgcaggctgcacaagaagcatggcaccagcacttgcttctggtgagggtctcaggctgcttcaactcatggtggaaggggaagggaagctggcacgtgcagaaatcacatggtgagggaggaagcaatgggggtgggggaggtaccaggctctttttaacaaccagttctcgagggaactaatgagcaagaactcacttattatgacaaagatggcaccaagccattcatgagggatctaccccatgactcaaacacctcccattaatccctacctccaacattgggatcaaatttcaacatgaggtttggaggcaatacacattcaaactatagcattccccctgaaggatcccagggaatttcacaccacagtatggcattctgatatgctgattgtaaaaaattaaagtaaaatgctgggagatacttcacactgatattgacttatttaccttaagaccagccctgccaaatagaatacaatc

SEQ ID NO: 29715 - DNA, 440 bp, Homo sapiens
atcattcctaccccttccatatgtgtatcaattacacttaggccccaatgcagtgcttgtatgcattgaaagaaagaagagagcaagaaagagaggcaaccgtgtgtgaaatggccatgacttttgtagcgtagtcaatgtacaggaatttatgatatagcttcctcagacgtcaataagtaaaactcaatacaaagggggtaatttatttatatgcgcaggtaacccaaatgtattgctggtgaaggatctaatcaaggcaatcatgcttaaaatgcaattaaagtcagctatacccaatgtttctcaaatcttagtatcatatggacccctttaaaaaataaagactttctgatgagacccagggtttatgtatattgctttttaataatgttttttgaatgtgtataaagctgttaacaaatgccttatacgcataa

SEQ ID NO: 29716 - DNA, 954 bp, Homo sapiens
  misc_feature (631)..(631): n is a, c, g, or t
atgggaacagataaccagacttgggtgagtgaatttattctcctcggcctgtccagtgactgggacactcgggtctccctgtttgtcctgttcttggtcatgtatgtggtgaccgtgctggggaactgtctcattgtccttctgatcagactggacagccgactccacactcccatgtatttctttctcaccaacctctcccttgtcgatgtctcctatgccacaagtgtagtccctcagctgctggcacattttcttgcagaacataaagccatcccattccagagctgtgcagcccagttatttttctccctggccttgggtgggattgagtttgttctcctggcggtgatggcctatgaccgctatgtggctgtgtgtgatgccctgcgatactcggccatcatgcatggagggctgtgtgctaggttggccatcacatcctgggtcagtggcttcatcagctctcctgtgcagactgctatcacctttcagctgcccatgtgcagaaacaagtttattgatcacatatcctgtgaactcctagctgtggtcaggctggcttgtgtggacacctcctccaatgaggtcaccatcatggtgtctagcattgttcttctgatgacacccntctgcctggttcttttgtcctacatccagatcatctccaccatcctaaagatccagtccagagaaggaagaaagaaagctttccacacgtgtgcctctcacctcacagtggttgccctgtgctatggtgtggccattttcacttacatccagccccactccagtccctctgtccttcaggagaagttgttctctgtcttttatgccattttaacaccaatgctgaaccccatgatttacagcctaaggaataaagaggtgaagggggcctggcagaaactattatggaaattctctgggttaacatcaaagctggcaacttga

SEQ ID NO: 29717 - DNA, 369 bp, Homo sapiens
caaccccaaatccatccaaccctcaccccaccaccaacccaacccccagcccaactcccaccccaacccccaactcaacccccaccccaatatccacccaaccccactccaacccctataatctggtggacagagccggggctgtgtgggcctggtgggctgtgtgagctcgcgcaccgccgggctggtctttgacatggccccacttgcgtggagccaaggctcctgtctcccagaagggtcagctgggaatgggggaccaccctccagggccccgaggagggatggggagacacatttcgtcctccggagccaggagagtgaggggccggacgagctcggcccatggcgcttcctggcaaccctcga

SEQ ID NO: 29718 - DNA, 300 bp, Homo sapiens
tgaaatacatagagtaggtctgaattgaaatgtcaggcagctactagtatctgcattagttttactcatggccctattgatgtacttgtggagacagcaaaaagggatgacaagttgcatcaacactagaaacaaggggtctaagtacgatttttgccaagactagtgtaagaaagcagcagtagagggaaaagagatgtagacagggataaaggagagatttctacctctccaccacagaaatatggaaactttgcagtcagcaaggtagtgatcatcgcttaatacacagtttcaaac

SEQ ID NO: 29719 - DNA, 356 bp, Homo sapiens
ctaatctgaaaaattattggtaataagggccatggtaatttcaatttcagtttcaacagaatatttattatattaaaacacaaggggcacaatttacaaggctagtatgatatattaggtgtagtttaaaaatgataaagtgctttaactaaaagttattttatatcaacttaattctctatcaaagtaagtaactttatctctatcagagaaaagttaaactgaagttcagaaaggttatctaaattaatgtaagttgtgattgcaaagtaaggatttaagcttatgtcctccaaacttgaagtcctgtttttcaattctatagctgtggtgtgctggtaaaccagctcgtaaaa

SEQ ID NO: 29720 - DNA, 339 bp, Homo sapiens
tcctaaaatcaggtttcagtgtaaagtttgtatgaatacacaaggccagtcttgactgagatgattttgttaggtgtagatttaaaactaactttcccaaaagttgtttgtagcaaatgctattattgaacacttaaattataaatactctatttaaattatacccttatctgtatttcacatattaaacaaaacacttagcaaagttttagagagccaattaattttttaataaacttttattttaagattctttttatttttaattttgggcttcaaaagtactcttaattattaccttggaattatggcctttctgatctcattcattgtctctct

SEQ ID NO: 29721 - DNA, 358 bp, Homo sapiens
taactcctgacctcaggtgatccacccgcctcagcctcccaaagtgctgggattataggtgtgagccactgagccctgctgctcccagtaaattctgctggaaagaccagagtgctcttttggccagtcgctcagcagtgtcctggccatctacccgaggatctccctgcttctggacctctgcttccctcccaccactgtcagggtggagccccctcgtcaccaagttgctgtactgcagtagctgcctcctggcaccaggtgtgcccacctcccaccacggctaccagagctgtcttcctcaaacccagctcagatggtgttgccctccacgttacatggctccacgctgccacta

SEQ ID NO: 29722 - DNA, 2274 bp, Homo sapiens
atgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtccatgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatga

SEQ ID NO: 29723 - DNA, 2453 bp, Homo sapiens
ctggagtggggtaagaggcgaattatagacacaaggggctcctctgcaggaaggaggccaagggaaagaggcttgaaaggcttgatatttcacccaccaccactcactgccggagtaagcaggtctccccttcccagggctgaggggaggcagggatgtgtgctgtcccagggctgagaagtggcaggtgagctggtgattccttactgcccaggttctgtctaggaaggtgcgtcctcaccatgctggatggtgtcctagtccaggagcaccccctgagctcctggcctagactccaaagggttgggtagatgagcaaagactttacaaagaccttaggcgatatatgtccaggagcacccaggaattactgggctaccactgcagactgcaggacaagctccaagaacaggaaggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgcgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaa

SEQ ID NO: 29724 - DNA, 1561 bp, Homo sapiens
tgctgaaggttctgggctgcaaagctgaagctttggtttctgctctaaatgaaggacttttccaggacccaaggccacacactggaagtcttgcagctgaagggaggcactccttggcctccgcagccgatcacatgaaggtggtgccaagtctcctgctctccgtcctcctggcacagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccaggagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgcgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaaaaaaaaaaccaaacaaacaaaaaaaaacttttttgggccgcctgggccctgaaaaagttttttaacacctttctgttgggcgccgggccccattggttagtggacactgggccatagcgtgttccccaaggaaaccggggcaagaaacaagggcgtgga

SEQ ID NO: 29725 - DNA, 1507 bp, Homo sapiens
tgctgaaggttctgggctgcaaagctgaagctttggtttctgctctaaatgaaggacttttccaggacccaaggccacacactggaagtcttgcagctgaagggaggcactccttggcctccgcagccgatcacatgaaggtggtgccaagtctcctgctctccgtcctcctggcacagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccaggagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgcgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagttagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaaaaaaaaaaccaaacaaacaaaaaaaaacttttttgggccgcctgggccctgaaaaagttttttaacacctttctgttgggcgccgggccccattggttagtggacactgggccatagcgtgttccccaaggaaaccggggcaagaaacaagggcgtgga

SEQ ID NO: 29726 - DNA, 2280 bp, Homo sapiens
tgctgaaggttctgggctgcaaagctgaagctttggtttctgctctaaatgaaggacttttccaggacccaaggccacacactggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgcgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaaaaaaaaaaccaaacaaacaaaaaaaaacttttttgggccgcctgggccctgaaaaagttttttaacacctttctgttgggcgccgggccccattggttagtggacactgggccatagcgtgttccccaaggaaaccggggcaagaaacaagggcgtgga

SEQ ID NO: 29727 - DNA, 412 bp, Homo sapiens
tctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaaggtactttgataatgttctgctctcccaaggccacagggccctacgattgtctctccctttcctttcgttaggccagcatatgattaacgctacgtgattttctatgaatgtgttttcacgtttcaaaaacagattgatacacatattg

SEQ ID NO: 29728 - DNA, 536 bp, Homo sapiens
gggcatggtggctcatgcctgtaacccagcactttgggaggctcaggcatgagccactgcgcccactggcctcgttgttttaaagacaactatgagttaattccttagaacagtaggattctgaaattttaagcctagttagaaatctaccacgtgactgtatcaatgccatcttaaggagtcagggatgtgtatgcagaatggaaatctaacttactgattagccagagtcaccatgacaaagcagttatgatcatgggatttggctgtacatacttagtatagataatggggatcttaggactgaattggcaccatcccttgtagtgatctgcaacttttattttcaaacagttcctactggctaaatgacaacttcagagaatgaacacatctcatccacagagtcaagaacagagcaagagctcagtaggtgtcacctagaaggattataatacattgctgtacactactgggaaatcaatgtagtttaacactgttctgcaccctgccaaaggcaccaagtaagtacatca

SEQ ID NO: 29729 - DNA, 448 bp, Homo sapiens
cagggcattcttgataaagcacacccagacccagcccagaggcctcacacgaagacaaagaaaaccccagaacttcattcagcccagtgtttctgtagctccaccttaactgagacatttgattatgcatgtattctggcatgaattaagacacaaaacttttgtatatgtgaatgcacagttggtttcaacattggtgttaccataacaagccctggccactaatggtacatcattcctggctcctctctgcacacccctccccagcacatctatcccacttccgtgaggatgtagctcccagctctgcaaacaattctgccctgatgacctaatgacctctcaccacacaccacccatttccagactgaacagcaacaacaaaaacccaacagatatagtgggggttttccaattcagattcctcttcttccctgtcttcagacag

SEQ ID NO: 29730 - DNA, 3267 bp, Homo sapiens
gccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcatgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattc

SEQ ID NO: 29731 - DNA, 969 bp, Homo sapiens
gccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccaggtatcccgagttgttttgcatggtaattgttaaggaaaacaggcctgggccagcatggcagctcacgcctgtaatcctagcacattgggaggccgaggtgggcagtccacttgaggcaggccaggagttcaagaccagcctggccaacatggcaaaactccctcttttcaacaacaacaacaaaaaagcaggcctgtaccaaaccataaagcccctctgtgccatgtacttggccagaggtctaattaggggagcatgtggaaagatttaaggggatctcccaaatttagagattaggattggcttattacaacctgcttcagaac

SEQ ID NO: 29732 - DNA, 253 bp, Homo sapiens
gcacaggccctcccctgtaaccaaacaaggactagcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattc

SEQ ID NO: 29733 - DNA, 317 bp, Homo sapiens
tagcagccgcctactactactactactactactagaattctcggctgtgtttacctatgttatggatcatagaaggaaaactgggtcttggggagcgggtttggggatacgaggaaaatgcaggcccaatgccgaaacacattgcattcataatggacgggaaccgtcgctatgccaagaagtgccaggtggagcggcaggaaggccactcacagggcttcaacaagctagctgaggtgggtgtgtatggcagagcccaaagtgaacagtctgtggagaggtagattatagctagaaaaccaggctctgagtttgct

SEQ ID NO: 29734 - DNA, 3781 bp, Homo sapiens
gccggcccactgaagccgtggggacgcgcccagcggagctaatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatgtgggcaccatgatgtggcaggaaaccgacttagatgttcagaagaagtcagtgcagatacggaggaaatgggaatgggaagaagtctgcaaagccaggagaaccgaggaaaggcttttgcctccagaggtcacattgcgttataaaactctgggtggtaaaagattataggcttagaccagtgtctttggattctaatgctggctgctctccatagtccatctgattccccagaagtcagttatagctcttcgcaaaccttggtgacttcttattttctttcttgtttatccaagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcatgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattc

SEQ ID NO: 29735 - DNA, 3431 bp, Homo sapiens
gccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcatgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattcaaaaaaaaaaaaaaaaaaaaaaatgggggggggcgggccacagaaaggttacaaccaccgtggcgggggcccggaagaacagggcacacggccaaggaccggccgagagggggtccaccaaaaagcggggcgggtggaacagggcgggggcgaaagccaacgcg

SEQ ID NO: 29736 - DNA, 3150 bp, Homo sapiens
gccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcatgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattc

SEQ ID NO: 29737 - DNA, 2428 bp, Homo sapiens
gccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcatgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattc

SEQ ID NO: 29738 - DNA, 3409 bp, Homo sapiens
gccggcccactgaagccgtggggacgcgcccagcggagctaatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggaattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcatgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattc

SEQ ID NO: 29739 - DNA, 2355 bp, Homo sapiens
gccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcatgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttttttttttttttttttttttttttttttagggggggtgccaacccttttaa

SEQ ID NO: 29740 - DNA, 3165 bp, Homo sapiens
gccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaatgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcatgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattc

SEQ ID NO: 29741 - DNA, 3602 bp, Homo sapiens
tcatagaagttcgatactggagacgtgagagttgggaacaggtcatcgtaatatagacgtcgtgagtgaggggaatgatcaagatgtgggcaccatgatgtggcaggaaaccgacttagatgttcagaagaagtcagtgcagatacggaggaaatgggaatgggaagaagtctgcaaagccaggagaaccgaggaaaggcttttgcctccagaggtcacattgcgttataaaactctgggtggtaaaagattataggcttagaccagtgtctttggattctaatgctggctgctctccatagtccatctgattccccagaagtcagttatagctcttcgcaaaccttggtgacttcttattttctttcttgtttatccaagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcatgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattc

SEQ ID NO: 29742 - DNA, 2871 bp, Homo sapiens
ctagaggatccccatcggcacatcagcgggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcatgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattc

SEQ ID NO: 29743 - DNA, 2894 bp, Homo sapiens
ctaccatttgttcattggttgacctttatcagacagtatgtcttccagatgccctctaagggccaagagccaataacataatccagatgttatttcatagtcctaaaattggctcttagaaaaatcctggtggaaatgttgatctagtctcgttttagttctgctttaccacaggcaggtgatctggctgcctcaagtgacgcctccccctactagtgaatgaatcagggccagcagcagctgcagctacagctcaggatgcctgtaacattgtcatctctgggcttctgggtcctgcttagcctgctttttccctggaggactgaccagggatgcggcccagcaacatgttactaaatcatactctcctccctacctttcccagacctctcactcctgcctggtgttccaacccgttctgtggccagagtatacattttggaacctcttcgaggccatcctgcagttccagatgaaccatagcatgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattc

SEQ ID NO: 29744 - DNA, 2044 bp, Homo sapiens
cctagttttagaagtttcaatagcacactgctgcctggggcattgctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattc

SEQ ID NO: 29745 - DNA, 1861 bp, Homo sapiens
aaagaaagtgcatctaagagacaggcagctgatgagttgtggccctttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattc

SEQ ID NO: 29746 - DNA, 1483 bp, Homo sapiens
gccggcccactgaagccgtggggacgcgcccagcggagctaatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatgtgggcaccatgatgtggcaggaaaccgacttagatgttcagaagaagtcagtgcagatacggaggaaatgggaatgggaagaagtctgcaaagccaggagaaccgaggaaaggcttttgcctccagaggtcacattgcgttataaaactctgggtggtaaaagattataggcttagaccagtgtctttggattctaatgctggctgctctccatagtccatctgattccccagaagtcagttatagctcttcgcaaaccttggtgacttcttattttctttcttgtttatccaagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccaggtatcccgagttgttttgcatggtaattgttaaggaaaacaggcctgggccagcatggcagctcacgcctgtaatcctagcacattgggaggccgaggtgggcagtccacttgaggcaggccaggagttcaagaccagcctggccaacatggcaaaactccctcttttcaacaacaacaacaaaaaagcaggcctgtaccaaaccataaagcccctctgtgccatgtacttggccagaggtctaattaggggagcatgtggaaagatttaaggggatctcccaaatttagagattaggattggcttattacaacctgcttcagaac

SEQ ID NO: 29747 - DNA, 1020 bp, Homo sapiens
  misc_feature (804)..(804): n is a, c, g, or t
  misc_feature (806)..(807): n is a, c, g, or t
  misc_feature (812)..(812): n is a, c, g, or t
  misc_feature (1018)..(1018): n is a, c, g, or t
gccggcccactgaagccgtggggacgcgcccagcggagctaatcaggtgccactgaactgaagggattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagactctcaatcctgccggggtccaccgntnntgtgncagagttacatttggaactttcgaggcaccggcgttccaatgacatagtggtgaaagccgacagttcaaggcgaagccactggaggcgcacagacacacctcggagggctacctggccagcagacgcgaaaacgagcgaggatcccaacacaaaggccggcgaaaaacgacgagcccttagctagggcccggcagtgcacccgagnga

SEQ ID NO: 29748 - DNA, 545 bp, Homo sapiens
gccggcccactgaagccgtggggacgcgcccagcggagctaatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatgtgggcaccatgatgtggcaggaaaccgacttagatgttcagaagaagtcagtgcagatacggaggaaatgggaatgggaagaagtctgcaaagccaggagaaccgaggaaaggcttttgcctccagaggtcacattgcgttataaaactctgggtggtaaaagattataggcttagaccagtgtctttggattctaatgctggctgctctccatagtccatctgattccccagaagtcagtcgtacggggttctcccacctcacgaccttgttatacgac

SEQ ID NO: 29749 - DNA, 284 bp, Homo sapiens
ataaaactagttacatgtttattccaagaaaacttggaaaccacaaaaaactcataatttcacctttcagaggtatccacaattaacatttgatgtgtatttgtttttctagggaaaggctggaagggcttctctgtaatcagtgacttcaatcatcagtccctgtccccctttggtaaattattctcttcttccctcctcaggtgtttcctgaatgtctgttttgcatacacatcccgtcatgagatcagcaatgctgtgagagagatggcctggggggtgga

SEQ ID NO: 29750 - DNA, 558 bp, Homo sapiens
ggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaattttaaagattcttagatgtaaaacttgtttgctaactgcaacggaagaacaccttcttttgctgctgcaattgcctaccctccctcaggtgcacttggctagctccaagaccctggctttggactagggggcaccggaaga

SEQ ID NO: 29751 - DNA, 469 bp, Homo sapiens
aaatcactgttcttttcctctctttctcttgagaagctgtacatataccacctgattcatgcaagttgttttgtggatcatgccccacgtctttcccattattttgattgtgtcaattttttgattcgtgtttcctcctttttctcttcttagtaaaatcttacacttgagggcaacccccacgaggcctttttgacttctctagtccagtcatttagggcttacagcacttactatgtaccaagctctcgataaagttagcacgctaaagaagggtgctgttaaggaattttgcttgtcttggaaatagaattagttaacaattagggaaaattcagataatttgaactgaatgacagtgactttaagtgcattatacaattcaagcaggaagaaagtgatatgaattggaagagtctaagaagtttttgtggagatgctatgtattgaaaaattagtaagtttgggg

SEQ ID NO: 29752 - DNA, 526 bp, Homo sapiens
gcctggaacccgggcaatcaggagtctcctgcagccccagcagtgcctccatgcactggcacgctgcctgctcctcccctcacagccacagctgctggagtgttgcctacatctcagagccttttctgaagattttggcatccccacaccctgtcaccatgttcctgtgtctttccccatgaaggtttcaggcacacagaaagagttttccagccttatttgaagggaggccaaatgtctgctgcagtccctctgtgtcctgatttacagcaccagccttgatggaacatggcagggccttaacacccaactctttgggaaccttgaacgtgtggctgaatgaagccagcagaagctgacctccagtgtggacctctcagagaagtttgcatttacaagcccctttccttgaggatttcacagcatttaaataaatggctgtgtgcttatttggcctcatcgttagatgatttgcatggctatatcgtggtatattaaacaaggagtatatcctaccctcaagttc

SEQ ID NO: 29753 - DNA, 830 bp, Homo sapiens
ggcacaccttaatttttataacagcagagactacaatggaggctggtataaaagggtaatacttctttattattcaagggttgactggtgaacagtttcagttgtgccctgatttttcctatcttaggatattatcttagtgttttatcaacaaacctttcagagcttctttttgtgacatttctgcaatattgagtttatatgtactgtaggattaatctattattgctctatcagcattcttgactgagttcttctgtgtaactatgaccattcatgtgctatgagaaatttggaagtgtcatatttgtccttaccctcagaaaacatatagtttgattggacaaagcaataaaatttaaaagtatataatcaagaaaaaattagaatgcagagataaaaataatagatgttcagagaagagagaaataagtgaggggatgagatagtcatcaaatatacatgggagactgtgaaaccttgtggcagagccttgatgggatgcgtgtgggcttggaaaaggcggcaaagtgaagtctgggctttacttgacggagagaaacaagggaaaggggtttttgtgtgaccagtaaagattcaggcctgattatcctttaaagtagaacaaagagtcagaaattcaaagatggacatcactacagatccaataggtatcaaaaagataaggagatcttgaaactttatgcaaaaaatgaaatgggacattccttgaaaaactcaatacttatcaaaatagatttaagaaaaacagactatctgaatctgaataattggtaaagaaattaaattaattattaaacaaaaccccc

SEQ ID NO: 29754 - DNA, 818 bp, Homo sapiens
agtgattttgtatttgaacatgaagggcagtggcatcattgacctaagctagagtttcctcaccctcagcacttttgacattttagttgcataaccctttgcggtgggggcggtcccgtgcactgcagggtggctggcagcatcactggcctccacccagtgtatgctgttagcaaaacctcctttccccagtcttaccccagtcatgacaactaaaaatgtctccagataatgccaaatgacacttggggggcaaaatcacccatgatgggaggagtcatggacatggcatggatgctggggtgggtaggataggaaccctggggaaaggagttaggcccacacccttgaggagctcatgacctaggaagcttgttgagaacttttgactagggtagaatatttctagtagttgactgaaaatagctttggttgaggctattagtaaaaaatttgttttaaagaggtttaacatctgttttccatttctgcttttctgagttgctttgctgctcaattccttttattttagctgtcttccctcttgggacttcaaacatttgagtgtgtcaaaatttcccagtctaataggaaatatgttttgttcaaaaagaaataaagatatttataactgttgggctagaatgatggaagtttaacgctggttaagtgagactcaggtaacagacagcaaaggagatactttaatagtgaagggaacttgaagtctggttgtattcaagattcacttcctgttcttgtttatcactggaaagttgcaccttgtgaaagattttagatttagatcattgtattgt

SEQ ID NO: 29755 - DNA, 408 bp, Homo sapiens
gattctcctgcatggccagcaccatggagatttccagacactcttgctgtcctctgtaccattggagttggatgctcaggaatcagaatcagaagaaggatgggtgctggttgtgggcatgcatatagcagctggctgttgaggagaaaagggaaagcacagagagggggaggggagggttcttaggagccaggggcaggagcccagagcccagctcaggatgatggagtgggatgctgagctgggtcccaccagctcatgcgagctgattctttctatctcttcccaattctgcattcaatgacatcacattggtagcttcaaatcagtcatggctgggagtatttacaagacagaaattggcaaacaccataaatcaggattttatccttcttccagagctgattg

SEQ ID NO: 29756 - DNA, 947 bp, Homo sapiens
tttttaggctttttgatggaattgctacaacttggtgcatgcctgctcctaaaagaaatactcaggaattgtctcataaagtcctcacctactggcaaaaacaagatgttctactccccaggttgactttttcaagccccaagatgttgagtcagccattctccaaggatctcgatttccttttaatggaaaataacattaaacaccaaatataagcctcgctgtcccacatgcgtattggggacaagatgaaacctgcttccaggctactttggcagcagaactgaaaaaggctttttttccagatatatgatttctcatcgacagggttgcacagccctctttattgttcgtgtaaatgacacccttggatctgaacaatacacaccaggacaattgtgtgcaacagttctacaaactgatatttctaattaaaaaataaaaagtaaaaaaatttctaatgcatttctcattaaccaggatacgtacattttaaactctcattcagacagatattgcaatgtgtttgcttattatttgcttttgtgggtcacgcaaagccttccaatttgctgttagttggcatttgatgtacctatttccagacttcttatatacatatacaaatttggacacatgcagatagtattgtggttttgatacttgtttttttaaaaatagaattctactctataaattgttctgcaaattattatatctgaccagtataattttctgcaatgatgaaaatgttctatacctgtgactatggagcccttaaaaacatggctaatatgaacaaggaactaaacttttcattttattttatttcaatttacctaacttcgagtcgttagtagaagttacatgcagctagttgttaatgtattagacagctcagttctaaaggatcatatagattaccttcatgacctgagacaggaaaa

SEQ ID NO: 29757 - DNA, 303 bp, Homo sapiens
gatcacgaggtcaggagatcaagaccatcctgactaacacggtgaaaccctgtctctactaaaaatacaaaaaattagccaggtgtggcagcatgggcctgtagtccccagctacttgggaggctgaggcaggagaatggcgtgaacccaggaggcggagcttgcagtgagctgagatcacgccactgtactccagcctgggcaacaaagcaagactccgtttcaaaaaagaaaattgatggactagtcaaacaagttttatgttatcactactgaatggtaaagataataaaactatcaatc

SEQ ID NO: 29758 - DNA, 514 bp, Homo sapiens
caatccttcaaaaatgacgaggaaataaagaaattgccagataagcaatgtctgagaaaattcattcccagcagacctacttatatgaaatactaaatggaaacctataggtctggaaggaagtgaaaccagacagtaactctacccacagaaataaatatagagcatcagaaatggtatgtttagtacacataaaatattttataaatttatattttctcttaacatctctaaaagatataagattttatgcagcaatatttataacacttttttgttaaggttataacatacagatcacattacagagaggaggaaaaggagtgatagtgggcaataattctctatcttataggaataagttaataatattctgaaatggctgtgaaaggatgacgtagatactgtagtccatagagtaaccattaagaagttcatggctatttaaatataattaaatttttttatttccaaagggtaaaaatggtatgctaaaaagtacaaaataaggtat

SEQ ID NO: 29759 - DNA, 390 bp, Homo sapiens
aattcgcggccgcgtcgacagaagacgacagaagggggattgaattgactcaataggcaatgctgtgacacagggaagcacgaggccttgggggtcccatgggcaggcgcctcagccagcctcgggatgatgggcttcctaaaggaggcaattaataatgaggatggtgatagcatcaagaattatggttactctctgtggaataactgtctggagtgtctggagtgtcagacgctatgccacacggtttatgtactttatttaattttacaattgtcctataacacaggggtgtccaaccttttggcttccctggcccacattggaagaagaagaattgtcttgggctacacataaaatatacaaatactaatgatacctgatgagtga

SEQ ID NO: 29760 - DNA, 2423 bp, Homo sapiens
atggcaggctgtttccgcggagtaaaaggtggcgccggtcagtggtcgtttccaatgacggacattaaccagactgtcagatcctggggagtcgcgagccccgagtttggagttttttccccccacaacgtcacagtccgaactgcagagggaaaggaaggcggcaggaaggcgaagctcgggctccggcacgtagttgggaaacttgcgggtcctagaagtcgcctccccgccttgccggccgcccttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaaggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcaacaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagaacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaaggtaccaatcattgattttttttttttttgtaaactaaaatgtttaaaataaaatagcatttacagttaaaaa

SEQ ID NO: 29761 - DNA, 558 bp, Homo sapiens
gaactgaccacattgcctggtacacagtcagtgcttgttcattgtgattggtcaaatggataaacgaatgaatagctaacactacacttcaagagacactgaagtgtcatctattgaaggcttcttcacttccatgcccacaccttccaccagtgagactctggtcccctcaacatgtgtctgtctctgacatatcacctaagacagtttatcttatttatttacatgtgtatcactgtaggagaccaggagctcagtactgagcacagtatacttagcaccttatagatgcttaatgcaagtttgctggatgaacaaattactcttacttccattgtcatggtgccagtaagtccgtttgggcagcctgagatttcatcaggtgttttttggcatctgtgttagactgtttgctcattttgtgtttgtaagtggctaaaaatccttaaatctttctcataggaaccagttataaaccaggtctcacaattctgttacttaagcagaatttccagctctaagtggaggactttgagcttaaccctattaaatttaatc

SEQ ID NO: 29762 - DNA, 396 bp, Homo sapiens
gcaaagtcatgacgtgattgaggggtggatatgtgagctactgctggtcaatggaagtgattaagatgatccttgaggaagataatcattgctgctgttcttaggttaaacatagtggaggctagaagctcagatttggtgttggccaaatggccaagagcatgagtattaggaattgaaagagtatagagccagggctagagagaggcaagttttgaaatgtgtgtccaggcggtgactaaatccatacccccagcaatggggctagggaaatctcaaggccaaagagacaagaggggaaatgagggaatgagctgttgacaaaatgatcacggggaacagtggcatccagatagtcttgtgttcatcagtgaaaatttgcccctagaggtgaag

SEQ ID NO: 29763 - DNA, 586 bp, Homo sapiens
tccaacacatgagtgaagccagcgtggagctccataccagccctccatccagcccaccgattcacctaagttgttatttggagtacgtgggctgtatgttttctctctaacctttctgttgtaaatttctccaagaaaggaaaccaaatagaatcttggagaagatgttcccagttgggatgtcttactaaaggaagttgatccaaaatgcacaggggatggactgtgctgggtgctgtgtctcaccaaccagatttttacttctcttggaaatatgagtgttgagaagtcacgtgtgagccgttttctgggaatttccctgagataaaaagtaccacctccttcaagtttcagacgcctgctcagtggtcacatatctaatgatggtggacgcaggagtgtgaaggtcagctccattttctccgtctgcctttgtcatacaaatatgaaagctgcccttgaggctaagtatcattttcatgaaatggtttgttagtaggcacttagtgattgctgtttaactctaatttgtttttaaaatgtttaataataactactggataaaccatattgaacctataaaaca

SEQ ID NO: 29764 - DNA, 902 bp, Homo sapiens
ccagaaggaaaatgaaagaagaaatttaaataccacttgaagagaggtgctgcccagttcatgagtgctgctgctgtcctgcccaagtacccagcttgcagagtgccagagttagagtcccaggggtgttctccacagctgcatgcttgatccaggcctatcagatatattccattgaaagtcctcattctcaaatttaaaacaaagactttttgtgtacctcaatagcaatgcacacacagttggcttcacaaacatattgtacatttctttttttcatatttattcaacaaatgtatattgactacccaccgtgtgacaggtgttatttgttggcggaaccaggcatcatcagcaaacaaaactgacaaagcttcctgccctctgtggaaggcatctgaggaagagactggattttgtagcaacatgttattctcattataaactttatcattggaatactaaagccaaatcatcccccatctccttgatcaggatacccacttaatctaggcagctacacaattgtgagagcctttgtttttttctgctgaaacatccttaaaaagatacctcacaacccaagatttggcttttcttaaatacgatttttaatttttttcatttctatctagagatttaattggaaatggaaaatcatcaattttccaattaaatgtctgttccaatcaacattataccttttaggttgtcattgtcatttttaagtttaagcaactttaaggattttgaatctggctgcctgtaaattaaaggtgaaagtaatcattgtgttggattggtacattttgtcaattgagagtggtttccttgttcttagtgtatgaaaagtttatttttctaatgtagattaataaaggagataaagaaaaacaaaatga

SEQ ID NO: 29765 - DNA, 1527 bp, Homo sapiens
gtaatctatgacaagtaagctatctataaatggcaatgaagggtagaacaaattcaatgaaaatatctatttaatcctagtgtttactggtctagaagaataggctgagtaaattagtatttctctggctgttgtggtaacacattgcatgctataacagttttaagtaattacaggtgcattgaaatttatctatggctttgtcatcatattctaaaatgtcatgagtacttttttctgacctcaattactatgaaattggtttccaatatttaattaaccaagaatatcaagtctatagggtattattaaggtgagacttctgtagccttttcaataaagaccagaattttggagtgccttgaaccttaatcattgatctttaattcttattaagtcaactgcccaccttttaaagactgaggcccaggaagagtaagtttctctgagacaatgcatacagtacagtgcttcttgggtattggctctaagaccagatgcaaagaaaggctaaaatcccatttcattgttcattaggtgagaaccctttgttaagctgtgtaacctctgtgcatagtttcctcatcagcaaagtcagaaaaagtatgtacctgaaggactgattgtaaggctgggatgagagaatccatgtgatcagccctcaccaacaggtgctgcccagttcatgagtgctgctgctgtcctgcccaagtacccagcttgcagagtgccagagttagagtcccaggggtgttctccacagctgcatgcttgatccaggcctatcagatatattccattgaaagtcctcattctcaaatttaaaacaaagactttttgtgtacctcaatagcaatgcacacacagttggcttcacaaacatattgtacatttctttttttcatatttattcaacaaatgtatattgactacccaccgtgtgacaggtgttatttgttggcggaaccaggcatcatcagcaaacaaaactgacaaagcttcctgccctctgtggaaggcatctgaggaagagactggattttgtagcaacatgttattctcattataaactttatcattggaatactaaagccaaatcatcccccatctccttgatcaggatacccacttaatctaggcagctacacaattgtgagagcctttgtttttttctgctgaaacatccttaaaaagatacctcacaacccaagatttggcttttcttaaatacgatttttaatttttttcatttctatctagagatttaattggaaatggaaaatcatcaattttccaattaaatgtctgttccaatcaacattataccttttaggttgtcattgtcatttttaagtttaagcaactttaaggattttgaatctggctgcctgtaaattaaaggtgaaagtaatcattgtgttggattggtacattttgtcaattgagagtggtttccttgttcttagtgtatgaaaagtttatttttctaatgtagattaataaaggagataaagaaaaacaaaatga

SEQ ID NO: 29766 - DNA, 1527 bp, Homo sapiens
gtaatctatgacaagtaagctatctataaatggcaatgaagggtagaacaaattcaatgaaaatatctatttaatcctagtgtttactggtctagaagaataggctgagtaaattagtatttctctggctgttgtggtaacacattgcatgctataacagttttaagtaattacaggtgcattgaaatttatctatggctttgtcatcatattctaaaatgtcatgagtacttttttctgacctcaattactatgaaattggtttccaatatttaattaaccaagaatatcaagtctatagggtattattaaggtgagacttctgtagccttttcaataaagaccagaattttggagtgccttgaaccttaatcattgatctttaattcttattaagtcaactgcccaccttttaaagactgaggcccaggaagagtaagtttctctgagacaatgcatacagtacagtgcttcttgggtattggctctaagaccagatgcaaagaaaggctaaaatcccatttcattgttcattaggtgagaaccctttgttaagctgtgtaacctctgtgcatagtttcctcatcagcaaagtcagaaaaagtatgtacctgaaggactgattgtaaggctgggatgagagaatccatgtgatcagccctcaccaacaggtgctgcccagttcatgagtgctgctgctgtcctgcccaagtacccagcttgcagagtgccagagttagagtcccaggggtgttctccacagctgcatgcttgatccaggcctatcagatatattccattgaaagtcctcattctcaaatttaaaacaaagactttttgtgtacctcaatagcaatgcacacacagttggcttcacaaacatattgtacatttctttttttcatatttattcaacaaatgtatattgactacccaccgtgtgacaggtgttatttgttggcggaaccaggcatcatcagcaaacaaaactgacaaagcttcctgccctctgtggaaggcatctgaggaagagactggattttgtagcaacatgttattctcattataaactttatcattggaatactaaagccaaatcatcccccatctccttgatcaggatacccacttaatctaggcagctacacaattgtgagagcctttgtttttttctgctgaaacatccttaaaaagatacctcacaacccaagatttggcctcttacccaggccccttttcatagtgttcccgtgtatggacagccttcattggctatcgacaaattcagtctccccccctccctgtcgtgggcaaagcacagcaggcatgcacggcaagaatgtccctgtaaatgtgtacatacctcagggctgttattttggatggaccgttcatgtaaagacaaggatggcttttagaagtatacggatataattgtctataaaggcaggtttttaggataacagcgcaccacagcttcttttttaaatagtctgaataagaataaaatgaatttctacagaaaaa

SEQ ID NO: 29767 - DNA, 548 bp, Homo sapiens
tatgtacctgaaggactgattgtaaggctgggatgagagaatccatgtgatcagccctcaccaacaggtgctgcccagttcatgagtgctgctgctgtcctgcccaagtacccagcttgcagagtgccagagttagagtcccaggggtgttctccacagctgcatgcttgatccaggcctatcaggtgagttggctcttggctagtggtttttcttctcttgctgtacaaaagtccagacagtaatgtctttttttcatttttatagatatattccattgaaagtcctcattctcaaatttaaaacaaagactttttgtgtacctcaatagcaatgcacacacagttggcttcacaaacatattgtacatttctttttttcatatttattcaacaaatgtatattgactacccaccgtgtgacaggtgttatttgttggcggaaccaggcatcatcagcaaacaaaactgacaaagcttcctgccctctgtggaaggcatctgaggaagagactggattttgtagcaacatgttattctcattataaa

SEQ ID NO: 29768 - DNA, 580 bp, Homo sapiens
gacgattccactagtacatatgttgacagaatggggccagtggtggttcatatacctgtttgttgtcaaataccaggtctagatgttttcctcatcctcaaatgagagatcacatagcaatatgggacttataaaactttcagaacaaagggaacatcattatgaagatttagaggaagagcaactctctgaaaattatttattatagaaatgtaagaaattttgaaacttttctagcatccttagttgattcaggaagatatagcctctgtggaactgaagtataaaagtataaggaacaggctgagtgaggtggctcatgcctgtaatcctagcactttgggaggccaaggcaggcagtaacaaggtcaggagttcgagaccagcctggccaatatggtgaaatcccgtctctactaaaaatacaaaaattacccaggcgtggtggtgggcgcctatagtcccagctactcggaaggctgaggcagcagaatcacttgaacccaggaggcagaggttgcagtgagccgagatcgtgccactgcaccccagcctgggcaacagagtgagactccatctc

SEQ ID NO: 29769 - DNA, 150 bp, Homo sapiens
tcaacatagtgctggaagtctagccagagctactgggcaagaaaaggaaataataggcattcaaatggaaaaggaagaaataaaatcatttctgtttgcagataatatgatcttatgtgttacagtcctaaagattccagaataatattg

SEQ ID NO: 29770 - DNA, 487 bp, Homo sapiens
agcttgtgctaggctctggattagcagggctggggctacattcacttcctccccaagaggccctatctttctataccagtatgtagtttctctgatgagatcagcatggaagccagttgcttggtgtggtccaggaaggcttctgagaggaggctgctgctggaccttgaaggttggggagaagatcactgatgggatttgggagcatgcagaacagcgttattgcttcaccctggcatgccctttccttcatggactggattctccttttatctggattcccccattatatttcctattgcagccataataagtttctccaacttaatgccttagaacaacacaaatttattattttacagttctggaggtgggaagtccaaaatcatcgtcatgggtccttggtgctgggcccaccttccagtaggtttcaagaactgtgtgcccataaataaatcctccaaagagatgccaatcagcaggtacc

SEQ ID NO: 29771 - DNA, 655 bp, Homo sapiens
agtgatctgcccgccttggcctcccaaaagccactgcgcccagcctgatatgtattgttgatttattaatattgaactggccaacagcactgctatgcttgaacaaagcttattttagcacacactttttttttttttttcttgcaaggtacgtcacagtctccttgtgcttagaaacactggatagcacttaagcactatgtttgggggccattttaaacaatgaaatcaggaagaaaaagccccaaaattcaaaatatgtgacactaagtagattgtgaatagggcacttgtttatagtatgagacctgaagcaagaaagagtgtcacctttttgaattctgctgggaacatgcatattgggcaccttaaatttattgctgcactgtgcatgtctgtcaatgaatgtgaaagctctgcaatgattgattttgaggttacaaattttaatgaatactcatatttgcaagcatggaaccgttgaataatctgactataaatcacctacctcaagagttttttggaatatctaatatgtcgtattaaccaaccaaatctagactacaggatactgaaatttcataacacaaactaaaaaaaatcagtgaggacattgtctcaatcctgtattctcattaaaaaaaaaaaaattatg

SEQ ID NO: 29772 - DNA, 141 bp, Homo sapiens
cctgcagagcatcctaagagaaactaaggtccaaagagaaattttcttggcacctctctctaaagcaaaggaaaaaaatagcacaaaatagcatatcaaaaaagcatcttactaaaattatattgagagcttatacaaatt

SEQ ID NO: 29773 - DNA, 433 bp, Homo sapiens
ctttgctaactggttacagctcagtctcctgggtagaggccaggctggccgcccctagagaatctaagacgtctggaccagtgaccatctcctctcccctcctccactgtccaatttaatttcttgtccattttctgggcactgagtaggcacatggctattcctcctgctctccctcaagcaggagcagttgtcccagttactacatggcaccctctcttatttcactgaggacactcttaaaatgtcacctccacaaagacgccatcgctaaagccctactccaaatgaaaaccaacgtcactctctagggctgacctctttccctgtttttttctttgttgttgtttttgttttgttttgttttgtttcagctgagatcgcaccactgcactccagcatgggcaacaagagtgaaactctgtctcaaaaa

SEQ ID NO: 29774 - DNA, 557 bp, Homo sapiens
gctatggttccgagggcaggactatgggaggctgccctgtacggaaaagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttt

SEQ ID NO: 29775 - DNA, 752 bp, Homo sapiens
gtccgagctctggtccccacggtcatcacgctttgctttctcagccaagatctcggggctcagggcggaaacgcagcggatatgtattttcttccggggttggtggcgctcggctctcatgacctgcaggtgacagtgttggccggtgcgcggccctgcttgcctcgtgccccgcccttcgtgcttgaaaaaaaatcccgcgaagccttctccgaaagaacatgctggttctttggttgaaaagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttt

SEQ ID NO: 29776 - DNA, 643 bp, Homo sapiens
gtccgagctctggtccccacggtcatcacgctttgctttctcagccaagatctcggggctcagggcggaaacgcagcggatatgtattttcttccggggttggtggcgctcggctctcatgacctgcaggaaaagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttt

SEQ ID NO: 29777 - DNA, 1307 bp, Homo sapiens
gctatggttccgagggcaggactatgggaggctgccctgtacggaaaagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaagtttaattggggttttacttcactgttgtacttttaaaggggctgtgaataaatgtttatgaaatttttatttttatttttattttactctttctacatagagttttcaagttgagtgtcaatttcatgttaaggtagcaatatgaggaaacttctcctgtgcattgaagccatatgtccaattcagattgatttccagatctgtcagttagaaactctatgttaaacatctttttaaaatacaagtaagtcttcatttttaaaaatacagtagcctagtaaagaggtatgtagctttcatttaaaaaacaaacaaaaaatccacactcaaaaaaccataagttagtattcccaaatatgcaaagccagattcagtcttgcactgaaatgaactgccatactcccctcagaaggtagatgttctgttgaaattgctctctagttgtaatggcaacaatcagacccagtttagactatgaacatgaaaatctctctctaataactgtctctacactttgtatttccagggagaatgtttctaaggctcttgtatacttagataccttctgtatcatttatcctctagagtgtgcacttcagacttagtaggaaacactgcacaattctgtcagataagaaatatgtaatattttgtcttaaacatttattacgttagcacattatgtgatctcataattccatctattatgtatagagttaatgttaatacagtgtaagctactaaactgatgtttgtaacaagaattatggaagtgggttggacaactgtccactttatgctacatagaccctttcccagagattagggggctagcttccattattaaaattgcaaagattcacatggctta

SEQ ID NO: 29778 - DNA, 1307 bp, Homo sapiens
gctatggttccgagggcaggactatgggaggctgccctgtacggaaaagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttttatttttatttttattttactctttctacatagagttttcaagttgagtgtcaatttcatgttaaggtagcaatatgaggaaacttctcctgtgcattgaagccatatgtccaattcagattgatttccagatctgtcagttagaaactctatgttaaacatctttttaaaatacaagtaagtcttcatttttaaaaatacagtagcctagtaaagaggtatgtagctttcatttaaaaaacaaacaaaaaatccacactcaaaaaaccataagttagtattcccaaatatgcaaagccagattcagtcttgcactgaaatgaactgccatactcccctcagaaggtagatgttctgttgaaattgctctctagttgtaatggcaacaatcagacccagtttagactatgaacatgaaaatgctcttgtatacttagataccttctgtatcatttatcctctagagtgtgcacttcagacttagtaggaaacactgcacaattctgtcagataagaaatatgtaatattttgtcttaaacatttattacgttagcacattatgtgatctcataattccatctattatgtatagagttaatgttaatacagtgtaagctactaaactgatgtttgtaacaagaattatggaagtgggttggacaactgtccactttatgctacatagaccctttcccagagattagggggctagcttccattattaaaattgcaaagattcacatggctta

SEQ ID NO: 29779 - DNA, 1650 bp, Homo sapiens
ggaaaagaatacatacctacacacacacacacacacacattttcatggttgtttccttgaatatgggtaggattttaaggaagatacttgcagtagaattttagtgttatggggaaaaaattacagcaccacattggcctcaaacttagggagtaggcatgagtcaattatttcttaattagatggtttgagtaagaacattttttctatggccagtgcttccaaagtcaataccagatgtatggtgagaagaaatttaaattctaaaaggttttatggcagaaaatagagaaaggatacctagccaccagtttctctaacaataaagtgagcaactaagtactaaagaagatgagatatttgaattttcaacccacatgtacacaacaggattcagaaatacccaggaagaattctgcatgcttaaatacatagcatcctactgaaagaaagtgtctattaaaaacacagtgtagttgaacagctgagaaagcaaatttccattcattccccctatttaaagatatcaaagataaaactgtcaccatgacaaagcattattttttcaaagtaaaataataataataataataaagcaattacatacacacagaaaaagtgttggcttttcagtctctgtaagacttttcagtacttagttgaactaagtaagcacagtcttattccagagtggtcagtgtaaatctcttgtcctagtaaatacaatatgcaatctctgtcctgtcttttgcagattgtctaaacctgtttatgtcataaactggtttatgtcctttggtcctgaaataaaactcaatacttcacagcagggaaggaaccaagctgtttaaaactacttatctccgctatgaaggagaagtattttcaaggaatatcagaagaaagtagaaagtgagaggaggttccagctgggcttcctgggtcaagtaggggctcagaaagctgtgaaactcactcatttcctgcatgcggacttactttggtcctggatgaataatattgaagatatgtgcttaaaacattcctaacatcagaatttgcgcctgtgttttcttccccaagaaagctataaacagcgaaaattttgttgtaagcttccctgtgtcctctctccctctctcccttccccctcccctgaaactaaaaggaatgttaaaagcccacttttctgtgaccagcagaccttatctatggtcccaattccaattccttgtaaacacaatttgtaaaatcccgtgagatcctgtctcctttgccatcccgctgcaaggttataagtagagaaaacttaagttacaattccagttttcctcaagatctgagacatgttaattgtctttgtttctccctctggtaacatcttcccaccacacatatttcctgccttagagagtttaaaaggtgataaaaaaatctaacactggctaccccgctcgggaccccttccacgctgtgaaagctttgtactgtcactctgcttaataaagcctacagcttttttaaaaaaaaaaagaaagaaaaaaaaaaaggggggggggaaaaatcccggggggcacttgggcccgttttttgaaaagggcccaaagggggggaaaaaaggggggggggtaagcgggggaaaggtggttg

SEQ ID NO: 29780 - DNA, 1043 bp, Homo sapiens
gctatggttccgagggcaggactatgggaggctgccctgtacggaaaagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgagggattgtctaaacctgtttatgtcataaactggtttatgtcctttggtcctgaaataaaactcaatacttcacagcagggaaggaaccaagctgtttaaaactacttatctccgctatgaaggagaagtattttcaaggaatatcagaagaaagtagaaagtgagaggaggttccagctgggcttcctgggtcaagtaggggctcagaaagctgtgaaactcactcatttcctgcatgcggacttactttggtcctggatgaataatattgaagatatgtgcttaaaacattcctaacatcagaatttgcgcctgtgttttcttccccaagaaagctataaacagcgaaaattttgttgtaagcttccctgtgtcctctctccctctctcccttccccctcccctgaaactaaaaggaatgttaaaagcccacttttctgtgaccagcagaccttatctatggtcccaattccaattccttgtaaacacaatttgtaaaatcccgtgagatcctgtctcctttgccatcccgctgcaaggttataagtagagaaaacttaagttacaattccagttttcctcaagatctgagacatgttaattgtctttgtttctccctctggtaacatcttcccaccacacatatttcctgccttagagagtttaaaaggtgataaaaaaatctaacactggctaccccgctcgggaccccttccacgctgtgaaagctttgtactgtcactctgcttaataaagcctacagctttttta

SEQ ID NO: 29781 - DNA, 1361 bp, Homo sapiens
gctatggttccgagggcaggactatgggaggctgccctgtacggaaaagaagaagaaatggcagtaaagagggcaaccatcattccacccagcccaaaaggaataagagaaaccctatctttcaggattctcaagatacagagttttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttttatttttatttttattttactctttctacatagagttttcaagttgagtgtcaatttcatgttaaggtagcaatatgaggaaacttctcctgtgcattgaagccatatgtccaattcagattgatttccagatctgtcagttagaaactctatgttaaacatctttttaaaatacaagtaagtcttcatttttaaaaatacagtagcctagtaaagaggtatgtagctttcatttaaaaaacaaacaaaaaatccacactcaaaaaaccataagttagtattcccaaatatgcaaagccagattcagtcttgcactgaaatgaactgccatactcccctcagaaggtagatgttctgttgaaattgctctctagttgtaatggcaacaatcagacccagtttagactatgaacatgaaaatctctctctaataactgtctctacactttgtatttccagggagaatgtttctaaggctcttgtatacttagataccttctgtatcatttatcctctagagtgtgcacttcagacttagtaggaaacactgcacaattctgtcagataagaaatatgtaatattttgtcttaaacatttattacgttagcacattatgtgatctcataattccatctattatgtatagagttaatgttaatacagtgtaagctactaaactgatgtttgtaacaagaattatggaagtgggttggacaactgtccactttatgctacatagaccctttcccagagattagggggctagcttccattattaaaattgcaaagattcacatggctta

SEQ ID NO: 29782 - DNA, 888 bp, Homo sapiens
gtccgagctctggtccccacggtcatcacgctttgctttctcagccaagatctcggggctcagggcggaaacgcagcggatatgtattttcttccggggttggtggcgctcggctctcatgacctgcaggtgacagtgttggccggtgcgcggccctgcttgcctcgtgccccgcccttcgtgcttgaaaaaaaatcccgcgaagccttctccgaaagaacatgctggttctttggttgtcagtgccttacaagccctggaggcgggggtgaggtggggatgtggtccctcgcgaaaactcagtcagtggacaatagcattctgtttttcaaattggcatttcctcggaaacatgaacgaaggacacatggcaggtagacgacggcgcaagccaatcgattcctaccgctaggcccatagagatggatatcatgatgaaactcctatcttctcaggacttctcatgatgcagagttttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccagaccttgaaggaggctcacttcaacagcctgcagcagcgagggcaagctccaacatgatgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtgaataaatgtttatgaaatttt

SEQ ID NO: 29783 - DNA, 425 bp, Homo sapiens
aatttttttgtatttttagtagagacagggtttcaccatattggtcaggctggtctcgaactcctgacctcaagtgatccacccacctcggcctcctaaagtgctgggattacaagcatgagccactatgcccggcctgctatttttaacatctcctggaaaatatattaatgatgctttttattgtgtcatttattaaaaacttccactgtacaatgtgcacctttcttctttaaaatatgcacggtattgttttgaattgatcacatctgcccagccctctcaactccctcaactttactaggtcacctaaagcattggaagtgcctggatcaaaaggacaaacagagaccctggtaccatagatgaaaatattcaagcattataaatcaaggaaacaaaattttaaataagatatatttcat

SEQ ID NO: 29784 - DNA, 1025 bp, Homo sapiens
gcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaattcagggtgaatggactgctccgtctgagttcactgtactcagcctgaggttgcagactggtctgaaggtgtacaggtgccctctgtgcctattcagcaattccctactgaagactggagcgctcagcctgccacggaaaactggtctgcagctcccactgctcaggccactgaatgggtaggagcaaccactgactggtcttaagctgttcttgcataggctcttaagcagcatggaaaaatggttgatggaaaataaacatcagtt

SEQ ID NO: 29785 - DNA, 872 bp, Homo sapiens
aatttattttttagagatagtattgctttgttgcccaggctggtctcaaattcctgggctcaagtgatcctcccacctcggcctcccaaagtgctaggattacaggcatgagccactatgccgggccaaggcttttaagagtacagatcttgtctcatttgtttctatatacaatgtctcacacaaaatgtttcgtacacaagttgctaaacacacatttattgaatgaagaagcaataattaccaaattaacttcacaatgtaaactcgtgttacattaaagaacattagaggcaagtacaaggcagtaaagccaagaggtatttgattttctttaatcaaatatttataaagaagtcaggcaataggattctactagaaaaacaatggctacattttaaaatcatgggtttttctagaagctgaaaagacctggtttggatgtgacacacccttgcttttcttcctcccaggcccactattattttgaccacaccatctacagagatgtcatagcacatccaggcaggcactggcttcataggagagttttctgtctgctttcttcccaccctctactcaaataaccatatcacaattgtgtcacacaactctacttctacgtgcaactttactgcctaacctctcccaaatcattcctaatggaaaaccaccaccacatccaaagtggtgtcacagagctggcaagctgagacatgcattagctttatattggaaaaagagcggccgggcatagtggctcatgtctgtaatcccagcactttgggaggccaaggtgggaggatcacgaggtcaagagatcaagaccatcctggccaacatggtgaaaccccatctctactaaaaataca

SEQ ID NO: 29786 - DNA, 422 bp, Homo sapiens
ggatggtggaagtatgggtgggagggagggatatttaggaagtacaaagaccagaacttggaacttcactggaagtggagagtcaataagagggacaggtccaggtccaggtcatggctggtgattttttgtacaagtgtacagagaagcagaggcagatttgtggggaaggtaagttaagttgtgaaagtgcagagtctaaggtgcccatgacatgggcatccaaggggctgtttggaggagccatgggctgtttctgccttgcagggaggattgttaggactgctaactgggctaatgcttgtgaaacacagggcctagcacatggtaaatacctcataaacaggaacccttattattattgggagttgtcaacttatatttgctaaatgaaaccccagttgctgataagattacttggg

SEQ ID NO: 29787 - DNA, 711 bp, Homo sapiens
gggtagctcaggtccaaaccggggctgggtgctgaagccactgtggggctgtggttttggcaagggtgagaaccctctctggtgtccttcctgggctccccagccccagctggggctcctgccacaaatgcagaccggggactgcctggtctctgaatttgctgtcctcatctgcacttagagtaattgcacttaagttgctgtcctcatctgcacttagagtaattaggtgcctcgcttagtcctgtgaccaagcctgattttgagtcgtggttacagaaacttagtctgtgtcttgtagccctgagctcctcctcttcctcaccagttaacaatatctcaaagaagggtgttgtcctgaaccattaccataaccccagcctaagctcaccctgaccaccactgtcccaggtatatcaccggctccagaactcctggctgccagggcaacccccgcccccagccccttgctctgggacaggagggagtgggtctcacctttagcctctgcccccggttctggtctgacccagcacatggcagctccaaagagcggacaaaaccttgaagcaaagccaaagggccaggcctgaatgggaggtcagagggaagaaggcccaggagagggtctaagccagccctgtctaagaggaatctaacgcaggcacataggtagctttctatggtggccacattagaaaaaagtaaaaa

SEQ ID NO: 29788 - DNA, 500 bp, Homo sapiens
ttgggatttagtatatggtttatgttgggcaactcattaatcactgtgcttcagtgtcatccatgaaactagggataaaacatgcatgggatgtgaagattaaaagtcaagaatatgaacagtacaagagagtaccataacaaatacaattttatttacaaatatacatggttggaccataccttggaatctacttgctaatgcagctgctgttaacagttcttgtatctgctcaagagatttctatgatcatataaaaatgcctttttaggttttcagtgttcatgccctgagtagtagtctgcagtttgctttaatacatggtaatacagagatcggctttaaatggctggctggttactgttgaatgaatgtatgataaattttttttcagaaccaacagtgtgaataatcctttcagttgtctatcagcatgaatttaaaaattactttcaagattcaacattacacaataaaacttagagttcttgcaatagaaa

SEQ ID NO: 29789 - DNA, 909 bp, Homo sapiens
ttattagcatttatcataatatgcaattattctgtttgttttgttgttcctcaagtgtttcttctattagaatgtaagctccctgaaggcaaaaaccacatctatcttgttcctgtagttccaatgcatagaacacaaattctccgattctggtggctaatagagtagggactcagtaaacattttaaaaataaaataaatgtactcaactataccaaaagatttattaagcaaaaaaggtaagatacaaaacagtatgtagtgtggaattccatttatattttgtaaaaattttgtgcagacacacacacacacgtgcatgcacattaaggatacacaaaaaactagtaactgtggttgcccctaggatagggactatgactcaagggagagaagatagaagtaattttaattttataatcattgttcctatttggatttttgttttactacatgtctatatttcttttataataataaaaataccatctagtactgttattttaaaaaggaaatatggaatagcaaaaaaaaaaaaaaaaaggaagaatcttagaataacagtcatttaaatggaacaaatttgtccttatgaaaaccccacaacattgtcctttttttttgcattccactgaggacctgggaaagcttcctccagccctgatgctggcctgcagtatggcacttgacagctactggtattgtggatagaagcaaaggctctggactcagcaacacttggtttgaattccagttctaccacttactagctgtggtgctgctgacaacttaaactccatgaacctcagttttcttcatctgtaaggtgggataacagtacttctctaatagggatattgtgaggatcaaatatgatgatctaaagcagttagcacaatatcttgcaca

SEQ ID NO: 29790 - DNA, 432 bp, Homo sapiens
taatagctagagttctatgaggatcctatttctcgtttctagctcaggcttcctttcattctctactttcttcttcttttttccccatctatcttcaagaattcccagagttccagtgccgctgttcccccaacagtcaccatcagaaaggccaactttgtatgatctgtatgcataaaataaatacatgatagaaataggagagaactctgtagatgattaggatagcagaattacatgatgtggagtagatgagagggcttgagtattccaaccaaagatgatggcttggtaggccgggcgtggtggttcacgcctgtaatcccagcactttgggaggctgaggcgggcggatcacgaggccaggagttcgtgaccagcctggccagcatggtgaaaccccgtctctactattaaaaaaactaataataa

SEQ ID NO: 29791 - DNA, 935 bp, Homo sapiens
aataaatatataagcaatgatgagaaactggaggtggctaatggaagtgagacagacaggggtggggggctccattatcttttaaaagcttcctccaaatgctcagtactgggaccaactaataggtagattttaatatggtggttttgttttggttttgtttttactacggtgctgatgtatatgtaatgtctaaaaaaagttatttgtacataagtttttacaatactgcagatatcactgggtctactatctgtaaaaaatatacatataaatatatatatactgtttgtttaaaatagagtatttttatttcattccttaactcatcatcacagcagtggtattgcacttcagatgacatctaattactaatttgtactgtatgacctctggcaacttgctccattttattcagatttttctagttttctgtttttactttgtacattgagcattgcttatttccttttaagaaatgtacagaacgctgaaatgtagaaatgaagtgatgttgacataccacttttaaagaaaacaaaaacaaaaataaaagattatctgaatcaatccaaagtatagtttattttaagatcctcactggatctccaatcttaattaagcagacatattattcctgggttttaattaactgcagttcttttctcaaaattttgatatcattctttaaacatttatttaatgggagagatcaatcattcccagcctttgcattcaactgcacaactgatgatgatactttctgaatttactgccgcactctgaaggatgtggcaaagggaagggaggaaagtcaactttgcatggaacatagtgcaatccatttgtagattcagtaccataacaattccatttccaactagttcatctggaggtagggaggctccactggaaaaataaatatttttgtcaaa

SEQ ID NO: 29792 - DNA, 320 bp, Homo sapiens
gcgtgttggtcagcctggtctcagactcctgacctcaggtgatctgcccgcctcggcctcccaaagtgctggggttgcaggtgtgagccaccgcgcccagcctacacctgctcttaattgtgttttgacatgctgggtactacaacattacataaaacataaccatggaaaaagaagtgagtactttacaatcttcaatgatatgtgatacaagaaaacttcattcttctgcagcaattgtccaccaaatacgtaaaaccatgaaatattaagtgagctcttacaaaataactgaaagtatttgcattcaaaaatgaaaa

SEQ ID NO: 29793 - DNA, 178 bp, Homo sapiens
tgaggacaaatgagatttcaaaggctgctaaaaggctgcttgagtattaaaggggacaatagcaacagcaaatatacttcaaataactccatgacagtgccatctgcttgtttaaccttgtactaagttactaaaacattttccacaattttccatcaaatacattttatagactcaa

SEQ ID NO: 29794 - DNA, 797 bp, Homo sapiens
  misc_feature (10)..(10): n is a, c, g, or t
  misc_feature (17)..(17): n is a, c, g, or t
  misc_feature (26)..(26): n is a, c, g, or t
  misc_feature (32)..(32): n is a, c, g, or t
  misc_feature (44)..(44): n is a, c, g, or t
  misc_feature (62)..(62): n is a, c, g, or t
atggggaaantgggccntggaggccnaaaaantggggcaacganggaaaagagctagcaccnatgagcttaaaaaaccctgggctctgtcactgtgcagctctgtccatcctttactgtgacaccaactcccaccttccccaaccctgccttcaacccctgggttcctcttcactttcttgcttcagcctggctcttcctttcaggcactaactccctggcatcccctcaacgtgcgactatcttctctccatacacaacctcttccctggcctaaagagaagtctttcttgctccttactgccacttccagatcactttccctttatctgccttaaaaatgcacaatggctcacatctgtaatcccaacattttggggggccaagcgggaggatcacttgagcccaggagcctgggcaacatggcaagaccctgtctctgcaaaaaaattaataccaaaaaaacccacaacatttactaacttagccatttttaagtgttctgtgacattaagtacattcgcgctgttggaaaacagatctgtgagtttttcatcttgcgtatctgaaactctatgcctgttggacaacagctccccttttccccctcctactagcccctggtaaccaccattatttctgtttctaccaatttgactactttagataacatatgtaagtggaatcataccatgtctgtttttcgtgacagacttatttcacttagtgtaatgtcctcaagactatccatgttgtactgtgtgccgcgatttctgaagacaggtagcggctcgattt

SEQ ID NO: 29795 - DNA, 998 bp, Homo sapiens
tgccactctggctgtgtgtctactgagtgcccgccagaccttgtgccaacagcttgacactgatcatcttcctgccctcccagcaagacccttttctcccagcttcctccagagtgaagagggggtcccagagctctgcagggtcctccagcccccacactggcccctccccaacacagccccacccccacagattgccctgaagaccagcagagctaccctccagggggccctttcttcctgttcacttcaaccattttgagaggccatcttcataccctgggctctgtcactgtgcagctctgtccatcctttactgtgacaccaactcccaccttccccaaccctgccttcaacccctgggttcctcttcactttcttgcttcagcctggctcttcctttcaggcactaactccctggcatcccctcaacgtgcgactatcttctctccatacacaacctcttccctggcctaaagagaagtctttcttgctccttactgccacttccagatcactttccctttatctgccttaaaaatgcacaatggctcacatctgtaatcccaacattttggggggccaagcgggaggatcacttgagcccaggagcctgggcaacatggcaagaccctgtctctgcaaaaaaattaataccaaaaaaacccacaacatttactaacttagccatttttaagtgttctgtgacattaagtacattcgcgctgttggaaaacagatctgtgagtttttcatcttgcgtatctgaaactctatgcctgttggacaacagctccccttttccccctcctactagcccctggtaaccaccattatttctgtttctaccaatttgactactttagataacatatgtaagtggaatcataccatgtctgtttttcgtgacagacttatttcacttagtgtaatgtcctcaagactatccatgttgtactgtgtgccgcgatttctgaagacaggtagcggctcgattt

SEQ ID NO: 29796 - DNA, 414 bp, Homo sapiens
gaccaatagcatcagcgtcccctgggaattgttagaatgcaaatcatcaggccctattccagacctagtgaaccagaaactgtgcagtggagccaggaatcctgatttaacaagctctacaggtgattctaaagcaggataaagaggaaaaaccatattagtaacacctgggagatttcaacaccaatgcccaggcccaggctcagatcaattaaatcagaatttctggaaacagggttttggcatcaatatggttctcaacgctcccagtagagaaccattgccttaggagcgtaccttttcaccccagagaaaaaagccaactggctgagtgccaaaactaaccctcactcaatgaattagttgaattctgcatttgtttgttttacttctttttacaatgaaagtttttcc

SEQ ID NO: 29797 - DNA, 397 bp, Homo sapiens
cccagctactcaggaggctgaggcaggagaatcgcttgaaaccccagaggccgaggttgcagtgagccacaacactccagcctgggcgacagagcaagactccatctcaaaaaaataaaaaaataaaaataaaataatctatcagattattctactaattagagtagcaggccaggtgtggtggctcacatctgcaatcccagcactttgggaggctgaagcgtgaggatcaccagcctgggcaacttagaccctgtctctacaaaagaacaaaaaatcaacactcgcctgtagtcccaactactcgggaagtgggatcccaggagggcgaggctgcagtgagccgtgatcataccactacactccagcctgggtgtcagagtagaccctatctcaa

SEQ ID NO: 29798 - DNA, 387 bp, Homo sapiens
tttttattttagaaagataatgtgcatacactgtacattatgtaacttccagcagagtttcagagcatatcaaacacctcaatatttctgctttgagatttatgattagtcactttaaatgagttaaataaaggctatgaagaagttcaggttttcccctcagatagattgtagtgccaaatttatggaggaaagatttggagtttttagaattttatggattttagaactgtgattaagggatcctggacatgtactagtctattttctgtgttttttgcatatttaaacatcttcaaaataaaaatttgttaaatagaaatatacaacttattcctaccactagtcacctaatttcatccactagaaacagccaaaggtattgat

SEQ ID NO: 29799 - DNA, 255 bp, Homo sapiens
gtttcctcatctgtaaaataagaataataacggttcctacctcacagggccagcgttagagtgaaaggagtcagtgtccacagagcagcaaccacagtgcccgcccatggtgagtgctggattggtgttcacatgagaacactgatgattacactgactatcatcaacttccctttaggcaccagagaagggcttggcgatcctcacctggggacccagacagcgcactgggttgctaaagaccacaggactggt

SEQ ID NO: 29800 - DNA, 378 bp, Homo sapiens
tgcactgaggagaaactgctgggaatagaatccaacctgacaataggaataacaacaccaacagaatgagaaattccggtgagaatgggagagggagcagagaaggaacatctcagaaagccaggatgtatttatctccttaaaaacaacaaaagaggtaattctagagctatgggcctagaaaagtgatctagacacatccttctctcctaaaagtggagaaaaactcatctttctgaaaaatgagcaacagaaaaaggatcgtgggtgaatcgcatacaaagttatgcaaaaaggaaaataaaaagcagaaaatgtctctattcaatgaagaatttagagaaatatgccgaaatagaagacaattataaccagatg

SEQ ID NO: 29801 - DNA, 268 bp, Homo sapiens
ctgcctcagcctgccaagtagctgggattacaggcgcccaccaccacgcccagctaatttttgtatttttagtagagacggggttttaccatgttggtcaggctggtctcaactcctgacctcaggtgatctgcccacctcggcctcccaaagagctgagattacaggcgtgagccaccaagcccggccttaaagtagggatttttacccccatcttacagaagagaaaaccgagccttagtgagaatagagaacttgcccaaggctc

SEQ ID NO: 29802 - DNA, 352 bp, Homo sapiens
tttttttttgagacggagtttcgctcttgttacccaggctggagtgcaatggtgtgatcttggctcaccgcaacctccgcctcccaggttcaagcaattctcctgcctcagcctcccgagtagctgagattacaggcatgcaccaccatgccaggctaattttgtatttttagtagagacggggtttctccatgttgaggctgctctcgaactcctgacctcaggtgatccgcccacctcggcctcccaaaagtgctgggattacaggcgtgagccaccgcacccgtccgagctagtttttttttgagtctcactgtgtctggagtgcagtggcgtgatcttggctcactgc

SEQ ID NO: 29803 - DNA, 680 bp, Homo sapiens
agttctgaaatcaatggagttaatttagggaatacaaaccagccatgggggtggagattgcctttgcctcagtgattctcacctgcctctcccttctggcagcaggagtctcccaggttgttcttctccagccagttccaactcaggagacaggtcccaaggccatgggagatctctcctgtggctttgccggccgctcatgagagtgtttttgtgtaaagtattttttagaatactgttgacttcttcatgatttaataaccatcctttgcgaagttttatgaggctttaggggaatgtcaaccctcaaatttttgttatactagatggcttccatttacccaccactattttaaggtccctttatttttaggttcaaggttcatttgacttgagaaagtgcccttctgcagcttcattgattttgtttatcttcactattaattgtaacgattaaaaaagaataagagcacgcagacctctaggagaatattttatccctgggtgcccctgacacatttatgtagtgatcccacaaatgtgattgttaatttaaatgttattctaatattagtacattcagttgtgatgtaatatgaataaccagaatctatttcttaaaagttttgagtatatttttcaactagatatttgtatagaaagactgaatagtgatgaag

SEQ ID NO: 29804 - DNA, 893 bp, Homo sapiens
gatagtgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtgatatatttaagaaaacgctaaaaagaatggaaattgtatgacaataacttaagtctttctccaaagtgcatgcagtcttttgcgatacctcattcagccgagtatttgtgctcttcctcattcagtataaggcagctttcagtttgcttagaaggcaacattggaatgttagagttcatcagaaacatagaattttaaactgtgagttccactgaatacattttaatgtctgtaggaagaatcaaaacacctatttaaagatggcaatatataataatcattttaaaagtatttgattaaacctaaattttccagaaatgaaaaaaaaaaaatcagctctaaaaccaaagctgatttcagaaaatttgaaaatgtaaatcagccctatccataatatagtttctctaaaactttattttaaagagtcattttaaaataatataactattaaaaaatgtaactgctatcttaatgttctgaaataatttaaaacattttaaaatatgaatactgtagtataaaagaaagaaatggtgggaacgaaaagcagagaaagaaatgccaattccagtccaaagttttatttgccaagttttcttagaatgaattttaccagtttatgaattattgtaaacagaatgtgtcatggaaatactgaaagatttttccctagagtggccttattgactgctggtgtgatgccactgtaatgtaataaattattaaattgtttctaagt

SEQ ID NO: 29805 - DNA, 835 bp, Homo sapiens
gatagtgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtgatatatttaagaaaacgctaaaaagaatggaaattgtatgacaataacttaagtctttctccaaagtgcatgcagtcttttgcgatacctcattcagccgagtatttgtgctcttcctcattcagtataaggcagctttcagtttgcttagaaggcaacattggaatgttagagttcatcagaaacatagaattttaaactgtgagttccactgaatacattttaatgtctgtaggaagaatcaaaacacctatttaaagatggcaatatataataatcattttaaaagtatttgattaaacctaaattttccagaaatgaaaaccctatccataatatagtttctctaaaactttattttaaagagtcattttaaaataatataactattaaaaaatgtaactgctatcttaatgttctgaaataatttaaaacattttaaaatatgaatactgtagtataaaagaaagaaatggtgggaacgaaaagcagagaaagaaatgccaattccagtccaaagttttatttgccaagttttcttagaatgaattttaccagtttatgaattattgtaaacagaatgtgtcatggaaatactgaaagatttttccctagagtggccttattgactgctggtgtgatgccactgtaatgtaataaattattaaattgtttctaagt

SEQ ID NO: 29806 - DNA, 320 bp, Homo sapiens
atagaaaggctgtttatgtatatctgatcttatatctagcagacttgttaaactgtctttgtatttgaaaaactgtaatttcttttagatttatatgtagacaattatatcttgtgcaaatagggatagtttttttttttttttcgaactcctgcagtacctgttatttcttgtactgaattggctaggaccgtcaagtacaacgttgaatgtaagttgtaacaacaagcatttttgttttatttctaattccaaaagagtggatctgtaaaattttactattaaataaaagctgtgaatatttgttagatgctcttttt

SEQ ID NO: 29807 - DNA, 165 bp, Homo sapiens
aaccaattagagctaataagcaagttcatcaagatctcgggatacaagatcaataaacaaaatcaactgcatttctacaagcgagaaatgaacaatcgaaaaataaaattaagaaaacaattctacttaaaacaacttcaaaataaaatacttaggaataaattt

SEQ ID NO: 29808 - DNA, 244 bp, Homo sapiens
ttttttagttagccaggcaggcatgatggtatatgcctatagtactattaataaccacttaggaggccggtgcaggaggatcacttgagcacagcagttcgaggttacggtgagctacgattgtgcccctgcactccagcctgggtgacagaaccagacctggtctcttcaaaaacaaaacaaaaaggccgggcccgggggctcacacctgtaatcccaggactttgggaggccgaggcgggcg

SEQ ID NO: 29809 - DNA, 395 bp, Homo sapiens
cctttatttcttttacttttttcaactccagtgagaaacaggcactaattatctacaacatatattgtagataacataacaacatatattctaacatgtaaaatagtttcagaattgctaatccatacccttctagggaaaaatacccattagaatcgagtgtttgtgtacatttcttaagtcatagtattcaatcaaaacgctgttttctgggccaggcgcggtggctcacgcctgtaataccagcactttgggtggatcacctgaggtcaggaattcaaggccagccttgccaatatggtgaaaccccatctctactaaaaatacgaaaattagctgggcatggtggcatgcacttatagtcccagagcaagactccgtctccaaaaaaaaaa

SEQ ID NO: 29810 - DNA, 657 bp, Homo sapiens
cttcctgatttttttcacctgaattctcaatttgttattgaatagttcagttttatttagggtttcaattttatttaggaaacaatatctctaccttacaaagaatctgcaagtagcactgactataatacctttatacccaaaggaagagctgggatagagctccctaagacttttctgcctgcaaaagatatgggtggggttgccatttgaatacagttaccaatgaaaaactatcagcttatctaggctttaacaataaagttcatgggggtaaagagaaaagatttaactttgaagtccccatatatcaaaaagaatattttacaggtaacttgacaaagatgtttcagtggtctcggaatgcaagacagaatcctgacggtagaaatttctaggcaagggtctaaattaggcaaactggtaagattgtgaatgtcccagcctttatttctgaatcttgacctctgaactctgctgcctctctctaaacatgtttctgcctacaggtacttcaggactgattttggtgtaagaagacagcaggtgtacacttgatgatgctacttccttacctctcattcattcctcaacccattgtaaaataatgtcaattaatataggttcctttgctgaacacctgtgaaccaaagcata

SEQ ID NO: 29811 - DNA, 482 bp, Homo sapiens
gaaaaaaagggcttactcattctagcagattctagcagcctcatcttgctaatcctgtcagttaatttcctcttgtccagtccccctgaagctacccttgtttcctgcaccgtttttttctcagcttgtttctcgaactgtcctatgaacctgggcactaccaataccctcccaatgtattgcttttgtgcttagtattaagactcagtttctgttatttgtgccaaacagtttcccaaacagaaagcaaaagccaaaaagaaaataaacgcccaacagaagcaatttgctaggtgctctgagatatacacacaggtatgaacttgtagggggaggtaggaaaattgggttcctgtctcaggtctgtcacctgtcttgctgtgtgaacttcaacaaacccccaaattcatcagtaaaatcaaagtctgggactagttaatcttcaaagtccttactggcgccagcagacaatgactgtgcca

SEQ ID NO: 29812 - DNA, 344 bp, Homo sapiens
gagttgctgggactacaggcacgtgccaccatgtctcactaatttttttgtatttttagtagagatggagtttcacattggccaggccggtctcgaactcctgacctcaagtgatccacccacctcggcctcccaaagtgcttggattacagatgtgagccaccgtgcccagccagaaaggctactatattatatagctttgtggtagactcctgtgggcctcttagatttaacaaaggtaagaattcccacttaattatttgaaaaaacatttcacttttattaaaaatactgctgtttgaaaaaggtgcttctccagtggcattcagtattggtggcctggc

SEQ ID NO: 29813 - DNA, 327 bp, Homo sapiens
ccaagggtcctgtggagtggggtggaggtaagggaaataaaatggccccagactgagaaccatgcctctaaagccagggctcctaacctggtatctaggatccccaaaataaaacataggtaggattctaggggtccttgaacttagatgggaaaattttacatctttacactaatatttaatagaaatttaacatttctttccataattaatgtaggcaacaggacttagtggtattattaccacgaattacacttgagacttgtaaccaataaaacatcaatggagtactattcagccataaaaaagagtgagatccaaccattt

SEQ ID NO: 29814 - DNA, 308 bp, Homo sapiens
ctcccgagtagctgggactacaggtgcctgccaccacgcccggctaattttttgtatttttagtagagactgggtttctactactacaacgattctttttttttaaacatatttttaacagttctttttaaaacagagacagttaaaatcaaaggaagccaggcataattactagcttcagtagtcttagtgacttgggaggttgaggcaggagatggcctcagcccagggttcgagtccagcctgggcaaccccatctggctttagacagtgagaccctgtctctatttaaaaaaaaaaaaaaaaaa

SEQ ID NO: 29815 - DNA, 438 bp, Homo sapiens
taaatttgttgaggcctgttttatggctcaagacacgagctatcttggtcatgttctgtggatacttgggaaaaaaaagtgtattctgctttgttgggtggaatgttatatgtatgtcactagatcctgttgtttatgttcagattatttatatccttgcttgttttctatagtagtactgtctagtagttctatcaatttttgagaaggggttgttgaaatccctgattataattgtaaatttatctatttttcctttcagctctgtcaggttttgtttcatgtattttgagactctattgttggtgtgtacacatttaggatcttatgtctttttcttattgttgaactttaagaatttgtggagccaggtgttgtggctcatgcctgtaatcccagcaagttgagagtccgaggtgggcagatcccttgagtcca

SEQ ID NO: 29816 - DNA, 372 bp, Homo sapiens
ggaagaacctcttactcttatacaactggttcctctacctggagaatagcttaatactgtccaatggagtaaagccccttggctggggaaggggaagtgaaggctccagcggcctgtggcgaaaaacaccaggcagatggctatgcaagacccttgggccatgcagggaagggagggcagaggggagccactgctcaccagtctgtcccaagaaaggaaagaaaagatcatagaaaggctgggttggtccccaacccctccgagcaacaggaggtgggggtgcagttttccataagcttagaagtctgaggatgaaaaacgacagtgagagattttgagtccccatttcactcaccgcttctggagccctat

SEQ ID NO: 29817 - DNA, 493 bp, Homo sapiens
ggcccctgaggggaaggtggggtttgagggagggaaagtgcagcacctgtggcaggaaaaaaaacaaaacagaactcgccaccaggaagcgttcctgggtcctgcacgcacgaaagttccttcccttcaatccctgcgctgggacccggggaccctggcgttcctgattccaacccagggagggcctcgggccagctaggggtatcgcaaagtgggcagaaggcccctgaggggaaggttaggtttgagggaggggatgtgaggcacctgtggcaggaaaaaaaaaaatcgcgccgccgagaagcggggcctgggtcccccatgcacgaaactgccttcccttcaacccctgctctgggtcccagggaacctggcgcccctgattcgaacccatggagcttctcgggcccgctaggggtaccccaaagcgggcagaaggcccctgaggtgaaggtaagatttgagggaggggaggtgaagcacctgtgtcagg

SEQ ID NO: 29818 - DNA, 223 bp, Homo sapiens
catcaccatcatcatcatcatcattgtcatttttgccatcaccatatcactttgtcctgtatctcccctcaaccctatgtcactgcatcattatgcttgattttaattatagtcatagaacccctacctactttcctcaattcagggcttctcctctattctatctaccacacgtaaaatcaccagagtgaaacttcaaccacagtggctactcctttgttgg

SEQ ID NO: 29819 - DNA, 281 bp, Homo sapiens
atcagagttatatagttttctttatatatagcttataaatgtattgttataatatatgtatttctttttccttttttggcaccaatgacaatggtaatgtgttttttaattgtaaattctacttgttcgttgctggcagatggggagcaattgacttgtatattaaccttgtagcctgtaatcttgctatgctcactcattagtttcagctttgttgttgattcttttggattttctacatagacaatcacatcatctgtgaataaatatagttttattgc

SEQ ID NO: 29820 - DNA, 359 bp, Homo sapiens
tttctttttcaaaatttttattcatctaggttacatgtcaaatgcacagtgaggaaaaggatattaagaaaatgcaataaaataaaaacagtaatttcataacattcttcccaaatcttaaagttatattaggaataagacttaattgccatagaatacacttctttgtggattattccttcactttttatgacatcttctattttacactgtggtaatttaatacaacatgagaatatctactcaatactagcaaacaaacagtttggttgcaacttccactaactttcctaaacttcagaggaaataaaaatagaaatcgggggaaaaatgagtaaagaaacttggaagttattccc

SEQ ID NO: 29821 - DNA, 1046 bp, Homo sapiens
tgtaactgaaggtgtctgtagtatggcccattcttctgagtcacttaggcaactgagtttggatttctgaatgatctgcatgttgtttctgtcttatgctttttcatgtcacgtcacttaagtagcataaatgcattagcattgataccagtatataaaacatttctgattcattcttacagtgagaaccagttagcatttaaccatgttttccatacattattttattaatttatgtcctcacttatctatccagtgccttatatatgtaaattactgtactattgttaaaacgactaagacatgctacttgcctttaaggcaggatccagcagactaccccatctggtgccaaatctggtctgtggcctgattttgtttagccctcaagctaagagtggtttttacatgtttaaagggttgtacaaacaaataaggaaacaaacaagaaaaagatgagacagagaccatatgtgtcctgcaaaacctgaaatatttactacctgatccttacagaaaaaattgtccaactcctgctttagaaaactttcattttaatcacacagatgtggaatacacacatgtacaaaaataaaaatagtacattttaataatagtgactgtattgatatttgcatgtatcaggcactgactaaataatttatatccattatttcatttagttctcacaacaaaactgtgagagatgtcttgttatttattaccattatacagataattcaaagaggtcaaataatttgtccatagtcatccagccagtaagtggtagagctagaatttaaaccaggctatttgattccagagtccattctctctgctattagagatctgaagtaagagatatatggtcaaaaaggaaagataaaattttctttcataagagcagtaaaaacttggaggaaatgggagcagggtgcggtggctcatggctataatcccagcactttaggaggctgaggtggagggttgcttgagcccaggagtttgagaccaacctcagcaacataatgagacctcgtctctac

SEQ ID NO: 29822 - DNA, 477 bp, Homo sapiens
atttgagccactttgtgaactccatgggagtcatcctgcactcctcagaaagtctcattatgtgaataataatcctttcataccctcttggtatatgcttgtaatcctaagtctcaacatccaaatgaagttttgggtggaggtcagtcctgcagggtgaccaccacaaaatcatagaatatgttctcagacaagaaatcaataactgcaagacaacaggataacctccaaacacttggaaattaaacaacatacttctaaatgatgcgtaggttgaggaagactcaaaaaaaaaaaaagaaaaaacattcaatcaactaaatgaaaatgaaaatataacatgtcaaaatttgtaggacacagttaaagcagtactgtgaggaaaatttatagcactaaatgtttacatcagcggagacaaaacgtctcaaatcaatcatctaagtttctacctcaagaaactagggggaaaaaaag

SEQ ID NO: 29823 - DNA, 530 bp, Homo sapiens
ggggtcagggccctcctaggaagcaactaggaaggaggggaggtttgcttgggagttgtccagctccaatcacccagaggccagtccccagggccccgcacccacgggggctgagcccagggaggcagcaggctgtgttgtcaaaggaagcctcaggccactgggaagttgctgggaaaagtttgcagcgctctcccccaggtgccctctgggcccctgggcccctgcttctccaaggacagaaacatgggttccctgaggcctcatgcctggctgccctcactctttccgaggagggtttcaagagccaagagctcaaagagaattagaccctgggcctgagagatcccagatctcacggggtggaggcccactgtatccaaccctcccaagacagtattttatcatctacagtcaggaagtgcttccttaggtctaactgccacgcctcctgctttcatgtaggtatgttctgcaaatgtggtatccaaaggtcaggccatatctgtatcttgggtgataaggaagtc

SEQ ID NO: 29824 - DNA, 557 bp, Homo sapiens
gttacatggtgtccccctaggactctccccagcttcaagctgctggcacccacttgcctaatcacgctggtaatcccgctgcttttccctgcaagctgcctgctttcactaaaggcacttccttaaacctggtgaaaaggcctcctcctcaaaaaatggatcgccccttcccactaaccttaggtcctactgtactcttggtgaatcacagctctttagagctccctcaagggccctaagcatcttttgttagaaaattctggctgaaattcctcatgagatgggtcagggaaccttggagtggcagcacttgtgtcacatcctaaaggcactcctctgactaaagagaagtggcagctgagcacactgcctgcccagggattttcttctgctctaaaggacattattaagacaactggtctgtactgtattgcctgatagtatcatatcaatgtcaatttcctcattttggtgattgttctaataagaatacgtaagaatgtgtccttgtttttagaaaatacacattaaatatcgagggatagagaaaaaaaaaa

SEQ ID NO: 29825 - DNA, 488 bp, Homo sapiens
gccatgtgttagatactgtgcatgtaaaacacaccagacatgggtaagatgttgccctcaaaaagctgacaggaatcccaacttcaaaaaaaaattatttcatcacacttgtaataagtctggtagcaaaaaaagctcaattgttggcacatacacactgaggcatttgagtcattgcttttagttattctaactaacatttctgtttggactgctcagaattaattactgattttgtggatcaaagctggagattcaaatacatgaatttctcaggtctttggggggaaaaccactgatgtaacttctactgaagagctgtgtctactggataccaagtcttgtctttctgcacattttaatatgcgactttctcaaggcagcatccacaggcactagacagggaactatagtgagcaccttctaaaagggagggcttgatttgtgagtgaaacaccgagatgctctctcaaaacacacaatttgct

SEQ ID NO: 29826 - DNA, 857 bp, Homo sapiens
cttaaagggtgaaatgacatttaaacattctttttgtatgcatattttccaaatgaagactcttaataatgctataaccaacatgatatttctccaaatgctctgtagtcatacctcaagtttatactttttattccatggtaaagggagttaataaatttaagattcacacttcaggcatgtggacatacacatacttccctctttccaagtgaagatcttagagcccttcctataagtgctgttggagttgaccttggcagccagcttagatactcctgtactggacaggtcctcactcagccccagccctagagtccatgcctgcaagggtgccacaccctaggtcttgggtgttgcttatctttcttcaagacatgcaaaagatgaataatatgtttatatttgtttttccaaagtccatacaagaagtgaagtaaagtaactatataccttaacctaagtaactatacaccttaacctgaaatctcatggagctgtatcaggtgcaaaagccatgctcttggccatctgcaggttcttccatagaggctgtgcatggtagtagataaaagcagacctcaggaatgagatttggtttccctatctttacaacagggatgctaataataccatatctgatttatagactaagaggactatgtgatttcttatgtgagtttcgttagaacactcatgacccttagcaagtggctccaccagagataactgtgatgtttattcccagtggaggctcttatgtctaacgtgtttcctttgtcttcttggtctttcttctctttcctatgtatattcctgaaattagggctctggggacatttactaaaaatgttaaa

SEQ ID NO: 29827 - DNA, 2900 bp, Homo sapiens
agcggaagccggtgtttcgcagcccagagcatttgcagctggtcactccagtctcctgggactttgactcgccgtactcggcgcgctcctgctgagggtcgccggagatgtcgctcggccgccttctaccaggagcctgatccgtgccgcccgccgcccggatgggaccaccagagtgctctaaagtctccagtgaatattgaattgctgaggattttgggaaaagacaaatcaaagttcccattccatggatcccttaggtgcaccttcccagtttgtggatgtggatacactaccaagctggggtgactcatgccaagatgaattaaattcctctgatactacagctgaaatatttcaggaagacactgttcgatcaccttttctttataataaggacgtcaatggaaaagtggttctttggaaaggagatgtggcattactgaactgtacagccattgtgaataccagcaatgaaagtctcacagataagaatcctgtgtcagaaagtatcttcatgcttgcagggcctgatttgaaggaagatctccagaaacttaaagggtgccgaacaggtgaagcaaaattgacaaaaggattcaatctagctgcccggttcatcattcacacagtgggacctaaatataaaagccgctatcgcacagcagctgagagttccctttatagctgctacagaaacgtacttcaactagcaaaagagcagtcaatgtcttctgttggcttctgtgtcatcaattctgcaaaacgtggttatcctttagaggatgcaacacacatagcacttcgcactgtaagaagattcctagagattcatggggaaaccattgaaaaagtagtatttgctgtctctgatcttgaagagggtacttaccaaaagctgctacctctctacttcccaaggtcattaaaagaggagaatcgatcattgccctacctacctgcagatattggaaatgcagaaggggagcctgtggtacctgaacgacagattagaataagtgagaaacctggtgctccagaagataaccaagaagaggaggatgaaggcttgggagttgatctctctttcattggctctcatgcttttgctcgaatggaaggagatattgacaagcaaagaaaactgatccttcagggacaattatcagaggcagctctgcagaagcagcatcaaagaaattataatcgctggttatgtcaagcaagatctgaggatctgtctgatattgcttctctaaaagccttataccaaacaggtgttgataactgtggtcgaacagtgatggtggtagttggaagaaacattcctgtaacattaatagatatggacaaggctctcttatatttcattcatgtaatggatcacattgctgtgaaggagtatgtattagtgtattttcacaccctgaccagcgaatacaatcacctggactccgacttcctgaagaaactctacgatgttgttgatgtcaagtacaagaggaatttgaaggctgtttattttgtacatcccacatttcgttcaaaggtgtcaacatggttttttaccaccttttctgtctcaggactgaaggacaaaatccaccatgtggacagcctccaccagctgttttctgccatatcaccagaacagattgactttcctccttttgtccttgaatatgatgccagggaaaacgggccttactatacatcatatcccccatcaccagatttgtgacctgccatctttcagtgcttcttggttcccaggatgccacttcctccacgaatagctacctgttgaagtgatattcattgttgctgtacagatccagagagccttttgtccccacctctctggtatttttttattgactgtatattttctggcacataagcaatctaaaaatggtaggccattctgaactgcacacattttaaatttgtatatttatatgaaatggaaatgttcatttttagattgttaatagaaattggggagcaacttttgagtatctttagtttcctgaaggacaccgaattctccattagataaaccaccaagactgttcacatcatctctctaacattgcacgcttcctttgtgtacttaagtgattctcgaaatatacagaaccaatgtatgctaaccagatgcattgtttgcttcagatccatggtgttaataccatgtatattttataaagataatttggctgtgttaaaagagaattacctgagtccaagaatgtggaaatgtatctgacaaaaaacatcaaaatcattagcaaaacataggacttagaatgttaatgtacaagttaagactaaagtttaaggactaaggttccttggattatatgacttgttaagattgccacagttccgatctcaacagtgtggggtgaaacaagaagactgtatcttcagcctttttcctataatcatggatgatttggtcttattcaaaaggaccgcacatattagtactcttaagagcatcttccaagactccagcagtgagcatttagagagtgtgttgtcttccagagtcatgaatgattttgtttagctatcaggtctactacctctaaggacatttcatagcagcatctcttgagttgcctgcatcagtgtggaggaagtgtgtcacagtgaacaaatccagggagctgataattggcaaaagaccacttttaccactcaggctctatttgtgccttagcttggttatgagtaaaaattagaattatgctgcctacctcacagaggtatcatgaagatagcatttagaaagggctttgttgtggtggggtatcttcagttagtttttaaatgggaataaatatatatgagggaatgctacacagcactcctcttgtccttgataaaattga

SEQ ID NO: 29828 - DNA, 1352 bp, Homo sapiens
agcggaagccggtgtttcgcagcccagagcatttgcagctggtcactccagtctcctgggactttgactcgccgtactcggcgcgctcctgctgagggtcgccggagatgtcgctcggccgccttctaccaggagcctgatccgtgccgcccgccgcccggatgggaccaccagagtgctctaaagtctccagtgaatattgaattgctgaggattttgggaaaagacaaatcaaagttcccattccatggatcccttaggtgcaccttcccagtttgtggatgtggatacactaccaagctggggtgactcatgccaagatgaattaaattcctctgatactacagctgaaatatttcaggaagacactgttcgatcaccttttctttataataaggacgtcaatggaaaagtggttctttggaaaggagatgtggcattactgaactgtacagccattgtgaataccagcaatgaaagtctcacagataagaatcctgtgtcagaaagtatcttcatgcttgcagggcctgatttgaaggaagatctccagaaacttaaagggtgccgaacaggtgaagcaaaattgacaaaaggattcaatctagctgcccggttcatcattcacacagtgggacctaaatataaaagccgctatcgcacagcagctgagagttccctttatagctgctacagaaacgtacttcaactagcaaaagagcagtcaatgtcttctgttggcttctgtgtcatcaattctgcaaaacgtggttatcctttagaggatgcaacacacatagcacttcgcactgtaagaagattcctagagattcatggggaaaccattgaaaaagtagtatttgctgtctctgatcttgaagagggtacttaccaaaagctgctacctctctacttcccaaggtcattaaaagaggagaatcgatcattgccctacctacctgcagatattggaaatgcagaaggggagcctgtggtacctgaacgacagattagaataagtgagaaacctggtgctccagaagataaccaagaagaggaggatgaaggcttgggagttgatctctctttcattggctctcatgcttttgctcgaatggaaggagatattgacaagcaaagaaaactgatccttcagggacaattatcagaggcagctctgcagaagcagcatcaaagaaagtaagacaacccttcaggactgttagatacataaggacatcagaagcaagaaaggaaccttgcatctgatgcatgagctacgtgtatatataatgcattccaatttatttttcatgacaatcagtgaggaagatatcgtcctcattttggag

SEQ ID NO: 29829 - DNA, 428 bp, Homo sapiens
tttttccagtatatgaagaattgttttagaggatagagactgattgttctcctctatcacttagaataagacagaaaggaattgtactgtagcacttatgagaattattaaacactgggatgattcactttcctggagctctttttaaagagaatggatattcatcactctgagttatccatttatgatgactagggcatagagtaggttaattttctattttgttttgttttgttttttcttggtctctgtgaaatagactactgttcaaaatgatcttcacctttattccccttttatcttttaggctctcttatatttcattcatgtaatggatcacattgctgtgaaggagtatgtattagtgtattttcacaccctgaccagcgaatacaatcacctggactccgacttcctgaagaaactct

SEQ ID NO: 29830 - DNA, 2488 bp, Homo sapiens
agcggaagccggtgtttcgcagcccagagcatttgcagctggtcactccagtctcctgggactttgactcgccgtactcggcgcgctcctgctgagggtcgccggagatgtcgctcggccgccttctaccaggagcctgatccgtgccgcccgccgcccggatgggaccaccagagtgctctaaagtctccagtgaatattgaattgctgaggattttgggaaaagacaaatcaaagttcccattccatggatcccttaggtgcaccttcccagtttgtggatgtggatacactaccaagctggggtgactcatgccaagatgaattaaattcctctgatactacagctgaaatatttcaggaagacactgttcgatcaccttttctttataataaggacgtcaatggaaaagtggttctttggaaaggagatgtggcattactgaactgtacagccattgtgaataccagcaatgaaagtctcacagataagaatcctgtgtcagaaagtatcttcatgcttgcagggcctgatttgaaggaagatctccagaaacttaaagggtgccgaacaggtgaagcaaaattgacaaaaggattcaatctagctgcccggttcatcattcacacagtgggacctaaatataaaagccgctatcgcacagcagctgagagttccctttatagctgctacagaaacgtacttcaactagcaaaagagcagtcaatgtcttctgttggcttctgtgtcatcaattctgcaaaacgtggttatcctttagaggatgcaacacacatagcacttcgcactgtaagaagattcctagagattcatggggaaaccattgaaaaagtagtatttgctgtctctgatcttgaagagggtacttaccaaaagctgctacctctctacttcccaaggtcattaaaagaggagaatcgatcattgccctacctacctgcagatattggaaatgcagaaggggagcctgtggtacctgaacgacagattagaataagtgagaaacctggtgctccagaagataaccaagaagaggaggatgaaggcttgggagttgatctctctttcattggctctcatgcttttgctcgaatggaaggagatattgacaagcaaagaaaactgatccttcagggacaattatcagaggcagctctgcagaagcagcatcaaagaaattataatcgctggttatgtcaagcaagatctgaggatctgtctgatattgcttctctaaaagccttataccaaacaggtgttgataactgtggtcgaacagtgatggtggtagttggaagaaacattcctgtaacattaatagatatggacaaggctctcttatatttcattcatgtaatggatcacattgctgtgaaggagtatgtattagtgtattttcacaccctgaccagcgaatacaatcacctggactccgacttcctgaagaaactctacgatgttgttgatgtcaagtacaagaggaatttgaaggctgtttattttgtacatcccacatttcgttcaaaggtgtcaacatggttttttaccaccttttctgtctcaggactgaaggacaaaatccaccatgtggacagcctccaccagctgttttctgccatatcaccagaacagattgactttcctccttttgtccttgaatatgatgccagggtaagaagtaccagaagttctccctcacctggtatggtatattaactgttctatagagcagcacttacgagcacaacatcctgtcattaccagatattaatgtaaattagtgagtcttaataaacttggtaatatcatttaacatactttccctatgataactttaggaaaaggatttgtcccaagagaggcattttctccagataaacgtttcagtgggagatctctctgctgtgagttcagaaccaattttcgtttgtattgtaagttttctaccatatttaaaacagatacctctgcctaattttcttaagattgaatggctttccatctacacagagccagaagaatttattggtgatcacttttagaattaattgcaaatcatgtggcctatctcagtagtctttaccctgctaaaagtttcatttatctaaaaggttgtataatgtttttaagagcatcatctgataatattattgttgttatttatagatgcgtttatggatctgttacataagcactagtcacaggactactcgtgaatttcatcaatttattctattgtgtttattcatgatatcaccttagtaatttttgaaaaaaaaaaagtaacacacttggccaaaagctcatcaagctgattgtttaactgttgctgattgcttatctttatattgtatgaaccaggggatagatttgaaagttatattaagtttgaaatgaattattcttccctaattattgtgcagtgtttatacagcaaaataaaaattctgcaacacaatttctctc

SEQ ID NO: 29831 - DNA, 471 bp, Homo sapiens
atgtatttgaagaaagtaacatactgatgaaatatgtagttcctactgcactgtgctaggtgcttttgtgcatactgtctcatttaattctccaccgtaacatggagaagttggtactgttatctccatttttatacaagaggtatctgaggctgaataccagacaaggctaaaacagaaactttcaatttgtgaaaaaggagtgttttagtgtcatatatatatgacaaatatatttattaagcctgttttatgtttgagggaaattgggtgcataaaaaggactatttttgagcttttgtacatatttataaaattgtatagttttgttgtcacatatgatggcatatatttatatatcttaatggataatttttgaagcatcactttgtaagaaagatgtttactacacagtaaaaagtttaaaagcaatgttaacctcgttatttatactcacactgtaaaaaactg

SEQ ID NO: 29832 - DNA, 358 bp, Homo sapiens
cgccaattggattattaagtactttacaatgtacaagaagaatttaagttagacacaagtcagtaaaggtggtgctatggtttgattgtgtcccctccaaaattcaggtgtggccagtatgatagtattaagaggtcggggctgggtgcagtggctcacacgtgtaatcccagcactttgggaggccaaggtgggcgaatcacaaggtcaagagatcgagaccatcctggccaacatggtgaaaccccgtctctactaaaaatacaaaaaattaccaggcgcagtggctcatacctgtaatcccagctacttgggaggccgaggcgggtggatcacctgaggtcgggagttcgggacc

SEQ ID NO: 29833 - DNA, 369 bp, Homo sapiens
gttttgtactatctcctttgatactctagaactacagaacagtgttgaagtgttacaactctgaggagagaagaatatacagtagttcttttttgttgttgtttttttgggacagggtctccctgtgtagcccaggttggagtatagtagcataatcacagctcactacactacaacctagacttcctggaccaagtgaccctcccacctgagtagccaggaccacaggtgcatgccaccatgcagtcctagccacttaaaaggctgaaacaagaggatcggttgagtccaggaatttgaggctacaatgagctatgatcataccagtttacttcagcccgggtgacagagtgagaccctgcctctcca

SEQ ID NO: 29834 - DNA, 3810 bp, Homo sapiens
acagagagattggtgtttttgtgaggcagtgagacctaaggtaacctttatcaaaaggatggagttgggaaaaggaaaactactcaggactggactgaatgcgttgcatcaagcagtgcatccgatccatggccttgcctggaccgatgggaatcaagttgtcctaactgatttgcggcttcacagtggagaggtcaagtttggggactccaaagtcattggacagtttgaatgtgtctgtgggttgtcctgggccccacctgttgcagatgatacacctgttctactcgctgtccagcatgagaagcatgtcactgtgtggcagctgtgtcccagccctatggagtcaagcaaatggctgacgtctcagacttgtgagattagaggatcactacctatccttccccagggctgtgtgtggcacccaaaatgtgctattctgactgtgttgactgctcaggatgtctccattttccctaatgttcactctgatgattcccaggtaaaggcagacatcaacacccagggccgcattcactgtgcatgttggacccaggatggcctgaggctggtggtggcagtaggcagcagcctgcattcttatatttgggacagcgctcagaagactcttcacaggtgctcctcctgcctggtgtttgatgtggacagccacgtctgctccatcacagcaactgtggactcacaggttgctatagctactgagcttccattggataagatctgtggcttaaatgcatctgaaacctttaatatcccacctaacagtaaagacatgactccgtatgctttaccagttattggtgaagtacgctctatggataaagaggcaactgattctgaaacaaattctgaagtatcagtttcttcttcctatttagaacctctggatctaactcacatacatttcaatcaacataagtctgagggtaattctcttatttgtctaagaaaaaaggactacttgacaggaactggccaagattcttcacatttggtccttgtgacctttaagaaggcagttaccatgacgagaaaagtcactattccaggcattctggttcctgatctgatagcatttaatcttaaagcccacgtagtggcagtggcttccaacacttgtaatataattttgatctactctgtcattccatcttcagtcccaaacatccagcaaattcgattagagaacactgaaagaccaaaagggatatgtttcttgacagaccaactattactaattttggtaggaaaacaaaaactcactgatacaacatttcttccttcttcaaagtctgatcagtatgccattagcttgattgttagagaaataatgttggaagaagaaccttcaataacatcaggtgaaagccagactacctactctactttcagtgctccgttaaataaagcaaatagaaaaaagttaattgaaagtctttccccagatttttgtcaccaaaacaaagggctgttgctgacagttaataccagtagtcagaatggaaggcctggaagaacacttattaaagaaatccagagtcctctgtctagtatctgtgatggctccatagctctagatgctgagcctgttacccagccagcatcgctgcccagacacagcagcacaccagaccacaccagcacactggagcctcctcgtttgcctcaaagaaagaacttacaaagtgaaaaggaaacttatcagctgtctaaggaagtggaaattttatctaggaacctggttgaaatgcaacggtgtctttctgaacttacaaaccgtctgcataatgggaagaaatcctcttcagtgtatccactctctcaagatcttccttatgttcacatcatttaccagaaaccttattatctaggtcctgttgttgaaaaaagagcggtgcttctctgtgatggtaaactaaggctcagtacagttcagcagacttttggcctttctctcattgaaatgctacatgattcccactggattcttctctctgctgacagtgagggctttatcccgttaaccttcacagccacacaggaaataatcataagagatggcagcctgtccaggtcagatgtcttcagagactctttttctcacagtccaggtgctgtttcttctcttaaagtctttacaggccttgctgcccccagtttagataccactggctgttgtaaccatgtagatggcatggcttgatatctgcagtgtccttgctgtgtagctcttcagatgagaccattacaaacaaggcctgcttgacactggacactcgccaatgagactcccactgcactcaggcgaagcgcttgccatggtcggctctcctggtttccccctgtttcccctgagctgaggctcgctgctgtgtagcagagctcagtctttattagatggctccgaaagtggtgtttatgtattcatgactgtgtggttttgactaagggcagaattctcagaacaaaacaatattatggtgccatatggatggtgttttatggtttctctgaggctttgtgtcccttgtccaaagctgcattgaagctgtcttaggagcacttaaaagataccttggcattgttataggtctttttcttggcttcaagaggaggttgaggagtctgctggggggcatgtgctctagcatattaacctcaaaccagcaagaattagcagagctccaaggaggaccagagacccactggcttctgctctcaggaacaggaagtggctctgatgttgcctggacctcccagaatttaaaccaaaccctcttgcttccttaacaaattctggctgacgaaggtccaggtactcttaaaaactggccctgggaaaattttgaatgaaatttcaagggaatttgtcccctctgggttccacttgaggttgtgccgatgctgctaccacactgtcgagcccaggtaagtcctactgcaggattttgtgctgtggccactcatgagtgtccctgaaataactttttttttttttaaatccagttttgggatcacgcaactttcctatttttctcccagtagtcagctcccttagttaacttgtcactttaatttgatatttttattttctctccttttaagtcttagagaccagcagagaatctgtgagagaaagtatttcaggaagttagaaattcaaccgaatctgaggtagtcctaaaaagtgccattttgtttcacttatgggctaaagtaccagcttagtcaggtaagagccctgacccacttcagatggtaacaccacttctcactgccttcagatggaatcacagatttcagtcacggcgcataacaaattgatcagtgagtggctaggcatctgcagataaattgtttcagccatagaagctccattagcacatatgcttccttttccccccttcctttaaaatcatctggaaagaaactattttgtgcccttggggactcctgtctgtctgttacagtttaccaagatggagctgggttaggaaagaagtgagggcccattttgtggttcaagtgcactagacagctgctggggtaggaagcacaggcaatgtctgtaatcagctgtgggagagcagtgactgagaacagtctgaggcctggctccacttggaagtatctggggtgcgatgaaatcacaattatcttgaagcctaaagagggaactacaagactgttaactaagatcaatgtgggcacctaaaagggtatgttaaaatcaccatttctcaggtcaaaatactgtgaataagtcttcaataaaatcactaatggtta

SEQ ID NO: 29835 - DNA, 3937 bp, Homo sapiens
acagagagattggtgtttttgtgaggcagtgagacctaaggtaacctttatcaaaaggatggagttgggaaaaggaaaactactcaggactggactgaatgcgttgcatcaagcagtgcatccgatccatggccttgcctggaccgatgggaatcaagttgtcctaactgatttgcggcttcacagtggagaggtcaagtttggggactccaaagtcattggacagtttgaatgtgtctgtgggttgtcctgggccccacctgttgcagatgatacacctgttctactcgctgtccagcatgagaagcatgtcactgtgtggcagctgtgtcccagccctatggagtcaagcaaatggctgacgtctcagacttgtgagattagaggatcactacctatccttccccagggctgtgtgtggcacccaaaatgtgctattctgactgtgttgactgctcaggatgtctccattttccctaatgttcactctgatgattcccaggtaaaggcagacatcaacacccagggccgcattcactgtgcatgttggacccaggatggcctgaggctggtggtggcagtaggcagcagcctgcattcttatatttgggacagcgctcagaagactcttcacaggtgctcctcctgcctggtgtttgatgtggacagccacgtctgctccatcacagcaactgtggactcacaggttgctatagctactgagcttccattggataagatctgtggcttaaatgcatctgaaacctttaatatcccacctaacagtaaagacatgactccgtatgctttaccagttattggtgaagtacgctctatggataaagaggcaactgattctgaaacaaattctgaagtatcagtttcttcttcctatttagaacctctggatctaactcacatacatttcaatcaacataagtctgagggtaattctcttatttgtctaagaaaaaaggactacttgacaggaactggccaagattcttcacatttggtccttgtgacctttaagaaggcagttaccatgacgagaaaagtcactattccaggcattctggttcctgatctgatagcatttaatcttaaagcccacgtagtggcagtggcttccaacacttgtaatataattttgatctactctgtcattccatcttcagtcccaaacatccagcaaattcgattagagaacactgaaagaccaaaagggatatgtttcttgacagaccaactattactaattttggtaggaaaacaaaaactcactgatacaacatttcttccttcttcaaagtctgatcagtatgccattagcttgattgttagagaaataatgttggaagaagaaccttcaataacatcaggtgaaagccagactacctactctactttcagtgctccgttaaataaagcaaatagaaaaaagttaattgaaagtctttccccagatttttgtcaccaaaacaaagggctgttgctgacagttaataccagtagtcagaatggaaggcctggaagaacacttattaaagaaatccagagtcctctgtctagtatctgtgatggctccatagctctagatgctgagcctgttacccagccagcatcgctgcccagacacagcagcacaccagaccacaccagcacactggagcctcctcgtttgcctcaaagaaagaacttacaaagtgaaaaggaaacttatcagctgtctaaggaagtggaaattttatctaggaacctggttgaaatgcaacggtgtctttctgaacttacaaaccgtctgcataatgggaagaaatcctcttcagtgtatccactctctcaagatcttccttatgttcacatcatttaccagaaaccttattatctaggtcctgttgttgaaaaaagagcggtgcttctctgtgatggtaaactaaggctcagtacagttcagcagacttttggcctttctctcattgaaatgctacatgattcccactggattcttctctctgctgacagtgagggctttatcccgttaaccttcacagccacacaggaaataatcataagagatggcagcctgtccaggtcagatgtcttcagagactctttttctcacagtccaggtgctgtttcttctcttaaagtctttacaggccttgctgcccccagtttagataccactggctgttgtaaccatgtagatggcatggcttgatatctgcagtgtccttgctgtgtagctcttcagatgagaccattacaaacaaggcctgcttgacactggacactcgccaatgagactcccactgcactcaggcgaagcgcttgccatggtcggctctcctggtttccccctgtttcccctgagctgaggctcgctgctgtgtagcagagctcagtctttattagatggctccgaaagtggtgtttatgtattcatgactgtgtggttttgactaagggcagaattctcagaacaaaacaatattatggtgccatatggatggtgttttatggtttctctgaggctttgtgtcccttgtccaaagctgcattgaagctgtcttaggagcacttaaaagataccttggcattgttataggtctttttcttggcttcaagaggaggttgaggagtctgctggggggcatgtgctctagcatattaacctcaaaccagcaagaattagcagagctccaaggaggaccagagacccactggcttctgctctcaggaacaggaagtggctctgatgttgcctggacctcccagaatttaaaccaaaccctcttgcttccttaacaaattctggctgacgaaggtccaggtactcttaaaaactggccctgggaaaattttgaatgaaatttcaagggaatttgtcccctctgggttccacttgaggttgtgccgatgctgctaccacactgtcgagcccaggtaagtcctactgcaggattttgtgctgtggccactcatgagtgtccctgaaataactttttttttttttaaatccagttttgggatcacgcaactttcctatttttctcccagtagtcagctcccttagttaacttgtcactttaatttgatatttttattttctctccttttaagtcttagagaccagcagagaatctgtgagagaaagtatttcaggaagttagaaattcaaccgaatctgaggtagtcctaaaaagtgccattttgtttcacttatgggctaaagtaccagcttagtcaggtaagagccctgacccacttcagatggtaacaccacttctcactgccttcagatggaatcacagatttcagtcacggcgcataacaaattgatcagtgagtggctaggcatctgcagataaattgtttcagccatagaagctccattagcacatatgcttccttttccccccttcctttaaaatcatctggaaagaaactattttgtgcccttggggactcctgtctgtctgttacagtttaccaagatggagctgggttaggaaagaagtgagggcccattttgtggttcaagtgcactagacagctgctggggtaggaagcacaggcaatgtctgtaatcagctgtgggagagcagtgactgagaacagtctgaggcctggctccacttggaagtatctggggtgcgatgaaatcacaattatcttgaagcctaaagagggaactacaagactgttaactaagatcaatgtgggcacctaaaagggtatgttaaaatcaccatttctcaggtcaaaatactgtgaataagtcctagctgcaggatgtttgtgctgtggccacgcaatgagtgtccactgaaataactttttttttttaaatccagtgtttgggatcacgcaactttcctatttttctcccagtagtcagctcccttagttaactggtcactttaagtttatc

SEQ ID NO: 29836 - DNA, 2280 bp, Homo sapiens
taggctaggtacgaggccggtggttgaatcggccgaggctagtatctgtgatggctccatagctctagatgctgagcctgttacccagccagcatcgctgcccagacacagcagcacaccagaccacaccagcacactggagcctcctcgtttgcctcaaagaaagaacttacaaagtgaaaaggaaacttatcagctgtctaaggaagtggaaattttatctaggaacctggttgaaatgcaacggtgtctttctgaacttacaaaccgtctgcataatgggaagaaatcctcttcagtgtatccactctctcaagatcttccttatgttcacatcatttaccagaaaccttattatctaggtcctgttgttgaaaaaagagcggtgcttctctgtgatggtaaactaaggctcagtacagttcagcagacttttggcctttctctcattgaaatgctacatgattcccactggattcttctctctgctgacagtgagggctttatcccgttaaccttcacagccacacaggaaataatcataagagatggcagcctgtccaggtcagatgtcttcagagactctttttctcacagtccaggtgctgtttcttctcttaaagtctttacaggccttgctgcccccagtttagataccactggctgttgtaaccatgtagatggcatggcttgatatctgcagtgtccttgctgtgtagctcttcagatgagaccattacaaacaaggcctgcttgacactggacactcgccaatgagactcccactgcactcaggcgaagcgcttgccatggtcggctctcctggtttccccctgtttcccctgagctgaggctcgctgctgtgtagcagagctcagtctttattagatggctccgaaagtggtgtttatgtattcatgactgtgtggttttgactaagggcagaattctcagaacaaaacaatattatggtgccatatggatggtgttttatggtttctctgaggctttgtgtcccttgtccaaagctgcattgaagctgtcttaggagcacttaaaagataccttggcattgttataggtctttttcttggcttcaagaggaggttgaggagtctgctggggggcatgtgctctagcatattaacctcaaaccagcaagaattagcagagctccaaggaggaccagagacccactggcttctgctctcaggaacaggaagtggctctgatgttgcctggacctcccagaatttaaaccaaaccctcttgcttccttaacaaattctggctgacgaaggtccaggtactcttaaaaactggccctgggaaaattttgaatgaaatttcaagggaatttgtcccctctgggttccacttgaggttgtgccgatgctgctaccacactgtcgagcccaggtaagtcctactgcaggattttgtgctgtggccactcatgagtgtccctgaaataactttttttttttttaaatccagttttgggatcacgcaactttcctatttttctcccagtagtcagctcccttagttaacttgtcactttaatttgatatttttattttctctccttttaagtcttagagaccagcagagaatctgtgagagaaagtatttcaggaagttagaaattcaaccgaatctgaggtagtcctaaaaagtgccattttgtttcacttatgggctaaagtaccagcttagtcaggtaagagccctgacccacttcagatggtaacaccacttctcactgccttcagatggaatcacagatttcagtcacggcgcataacaaattgatcagtgagtggctaggcatctgcagataaattgtttcagccatagaagctccattagcacatatgcttccttttccccccttcctttaaaatcatctggaaagaaactattttgtgcccttggggactcctgtctgtctgttacagtttaccaagatggagctgggttaggaaagaagtgagggcccattttgtggttcaagtgcactagacagctgctggggtaggaagcacaggcaatgtctgtaatcagctgtgggagagcagtgactgagaacagtctgaggcctggctccacttggaagtatctggggtgcgatgaaatcacaattatcttgaagcctaaagagggaactacaagactgttaactaagatcaatgtgggcacctaaaagggtatgttaaaatcaccatttctcaggtcaaaatactgtgaataagtcttcaataaaatcactaatggtta

SEQ ID NO: 29837 - DNA, 3841 bp, Homo sapiens
acagagagattggtgtttttgtgaggcagtgagacctaaggtaacctttatcaaaaggatggagttgggaaaaggaaaactactcaggactggactgaatgcgttgcatcaagcagtgcatccgatccatggccttgcctggaccgatgggaatcaagttgtcctaactgatttgcggcttcacagtggagaggtcaagtttggggactccaaagtcattggacagtttgaatgtgtctgtgggttgtcctgggccccacctgttgcagatgatacacctgttctactcgctgtccagcatgagaagcatgtcactgtgtggcagctgtgtcccagccctatggagtcaagcaaatggctgacgtctcagacttgtgagattagaggatcactacctatccttccccagggctgtgtgtggcacccaaaatgtgctattctgactgtgttgactgctcaggatgtctccattttccctaatgttcactctgatgattcccaggtaaaggcagacatcaacacccagggccgcattcactgtgcatgttggacccaggatggcctgaggctggtggtggcagtaggcagcagcctgcattcttatatttgggacagcgctcagaagactcttcacaggtgctcctcctgcctggtgtttgatgtggacagccacgtctgctccatcacagcaactgtggactcacaggttgctatagctactgagcttccattggataagatctgtggcttaaatgcatctgaaacctttaatatcccacctaacagtaaagacatgactccgtatgctttaccagttattggtgaagtacgctctatggataaagaggcaactgattctgaaacaaattctgaagtatcagtttcttcttcctatttagaacctctggatctaactcacatacatttcaatcaacataagtctgagggtaattctcttatttgtctaagaaaaaaggactacttgacaggaactggccaagattcttcacatttggtccttgtgacctttaagaaggcagttaccatgacgagaaaagtcactattccaggcattctggttcctgatctgatagcatttaatcttaaagcccacgtagtggcagtggcttccaacacttgtaatataattttgatctactctgtcattccatcttcagtcccaaacatccagcaaattcgattagagaacactgaaagaccaaaagggatatgtttcttgacagaccaactattactaattttggtaggaaaacaaaaactcactgatacaacatttcttccttcttcaaagtctgatcagtatgccattagcttgattgttagagaaataatgttggaagaagaaccttcaataacatcaggtgaaagccagactacctactctactttcagtgctccgttaaataaagcaaatagaaaaaagttaattgaaagtctttccccagatttttgtcaccaaaacaaagggctgttgctgacagttaataccagtagtcagaatggaaggcctggaagaacacttattaaagaaatccagagtcctctgtctagtatctgtgatggctccatagctctagatgctgagcctgttacccagccagcatcgctgcccagacacagcagcacaccagaccacaccagcacactggagcctcctcgtttgcctcaaagaaagaacttacaaagtgaaaaggaaacttatcagctgtctaaggaagtggaaattttatctaggaacctggttgaaatgcaacggtgtctttctgaacttacaaaccgtctgcataatgggaagaaatcctcttcagtgtatccactctctcaagatcttccttatgttcacatcatttaccagaaaccttattatctaggtcctgttgttgaaaaaagagcggtgcttctctgtgatggtaaactaaggctcagtacagttcagcagacttttggcctttctctcattgaaatgctacatgattcccactggattcttctctctgctgacagtgagggctttatcccgttaaccttcacagccacacaggaaataatcataagagatggcagcctgtccaggtcagatgtcttcagagactctttttctcacagtccaggtgctgtttcttctcttaaagtctttacaggccttgctgcccccagtttagataccactggctgttgtaaccatgtagatggcatggcttgatatctgcagtgtccttgctgtgtagctcttcagatgagaccattacaaacaaggcctgcttgacactggacactcgccaatgagactcccactgcactcaggcgaagcgcttgccatggtcggctctcctggtttccccctgtttcccctgagctgaggctcgctgctgtgtagcagagctcagtctttattagatggctccgaaagtggtgtttatgtattcatgactgtgtggttttgactaagggcagaattctcagaacaaaacaatattatggtgccatatggatggtgttttatggtttctctgaggctttgtgtcccttgtccaaagctgcattgaagctgtcttaggagcacttaaaagataccttggcattgttataggtctttttcttggcttcaagaggaggttgaggagtctgctggggggcatgtgctctagcatattaacctcaaaccagcaagaattagcagagctccaaggaggaccagagacccactggcttctgctctcaggaacaggaagtggctctgatgttgcctggacctcccagaatttaaaccaaaccctcttgcttccttaacaaattctggctgacgaaggtccaggtactcttaaaaactggccctgggaaaattttgaatgaaatttcaagggaatttgtcccctctgggttccacttgaggttgtgccgatgctgctaccacactgtcgagcccaggtaagtcctactgcaggattttgtgctgtggccactcatgagtgtccctgaaataactttttttttttttaaatccagttttgggatcacgcaactttcctatttttctcccagtagtcagctcccttagttaacttgtcactttaatttgatatttttattttctctccttttaagtcttagagaccagcagagaatctgtgagagaaagtatttcaggaagttagaaattcaaccgaatctgaggtagtcctaaaaagtgccattttgtttcacttatgggctaaagtaccagcttagtcaggtaagagccctgacccacttcagatggtaacaccacttctcactgccttcagatggaatcacagatttcagtcacggcgcataacaaattgatcagtgagtggctaggcatctgcagataaattgtttcagccatagaagctccattagcacatatgcttccttttccccccttcctttaaaatcatctggaaagaaactattttgtgcccttggggactcctgtctgtctgttacagtttaccaagatggagctgggttaggaaagaagtgagggcccattttgtggttcaagtgcactagacagctgctggggtaggaagcacaggcaatgtctgtaatcagctgtgggagagcagtgactgagaacagtctgaggcctggctccacttggaagtatctggggtgcgatgaaatcacaattatcttgaagcctaaagagggaactacaagactgttaactaagatcaatgtgggcacctaaaagggtatgttaaaatcaccatttctcaggtcaaaatactgtgaataagtcttcaataaaatcactaatggttattgtggctgttttggatgttttggtagtatt

SEQ ID NO: 29838 - DNA, 3501 bp, Homo sapiens
acagagagattggtgtttttgtgaggcagtgagacctaaggtaacctttatcaaaaggatggagttgggaaaaggaaaactactcaggactggactgaatgcgttgcatcaagcagtgcatccgatccatggccttgcctggaccgatgggaatcaagttgtcctaactgatttgcggcttcacagtggagaggtaaaggcagacatcaacacccagggccgcattcactgtgcatgttggacccaggatggcctgaggctggtggtggcagtaggcagcagcctgcattcttatatttgggacagcgctcagaagactcttcacaggtgctcctcctgcctggtgtttgatgtggacagccacgtctgctccatcacagcaactgtggactcacaggttgctatagctactgagcttccattggataagatctgtggcttaaatgcatctgaaacctttaatatcccacctaacagtaaagacatgactccgtatgctttaccagttattggtgaagtacgctctatggataaagaggcaactgattctgaaacaaattctgaagtatcagtttcttcttcctatttagaacctctggatctaactcacatacatttcaatcaacataagtctgagggtaattctcttatttgtctaagaaaaaaggactacttgacaggaactggccaagattcttcacatttggtccttgtgacctttaagaaggcagttaccatgacgagaaaagtcactattccaggcattctggttcctgatctgatagcatttaatcttaaagcccacgtagtggcagtggcttccaacacttgtaatataattttgatctactctgtcattccatcttcagtcccaaacatccagcaaattcgattagagaacactgaaagaccaaaagggatatgtttcttgacagaccaactattactaattttggtaggaaaacaaaaactcactgatacaacatttcttccttcttcaaagtctgatcagtatgccattagcttgattgttagagaaataatgttggaagaagaaccttcaataacatcaggtgaaagccagactacctactctactttcagtgctccgttaaataaagcaaatagaaaaaagttaattgaaagtctttccccagatttttgtcaccaaaacaaagggctgttgctgacagttaataccagtagtcagaatggaaggcctggaagaacacttattaaagaaatccagagtcctctgtctagtatctgtgatggctccatagctctagatgctgagcctgttacccagccagcatcgctgcccagacacagcagcacaccagaccacaccagcacactggagcctcctcgtttgcctcaaagaaagaacttacaaagtgaaaaggaaacttatcagctgtctaaggaagtggaaattttatctaggaacctggttgaaatgcaacggtgtctttctgaacttacaaaccgtctgcataatgggaagaaatcctcttcagtgtatccactctctcaagatcttccttatgttcacatcatttaccagaaaccttattatctaggtcctgttgttgaaaaaagagcggtgcttctctgtgatggtaaactaaggctcagtacagttcagcagacttttggcctttctctcattgaaatgctacatgattcccactggattcttctctctgctgacagtgagggctttatcccgttaaccttcacagccacacaggaaataatcataagagatggcagcctgtccaggtcagatgtcttcagagactctttttctcacagtccaggtgctgtttcttctcttaaagtctttacaggccttgctgcccccagtttagataccactggctgttgtaaccatgtagatggcatggcttgatatctgcagtgtccttgctgtgtagctcttcagatgagaccattacaaacaaggcctgcttgacactggacactcgccaatgagactcccactgcactcaggcgaagcgcttgccatggtcggctctcctggtttccccctgtttcccctgagctgaggctcgctgctgtgtagcagagctcagtctttattagatggctccgaaagtggtgtttatgtattcatgactgtgtggttttgactaagggcagaattctcagaacaaaacaatattatggtgccatatggatggtgttttatggtttctctgaggctttgtgtcccttgtccaaagctgcattgaagctgtcttaggagcacttaaaagataccttggcattgttataggtctttttcttggcttcaagaggaggttgaggagtctgctggggggcatgtgctctagcatattaacctcaaaccagcaagaattagcagagctccaaggaggaccagagacccactggcttctgctctcaggaacaggaagtggctctgatgttgcctggacctcccagaatttaaaccaaaccctcttgcttccttaacaaattctggctgacgaaggtccaggtactcttaaaaactggccctgggaaaattttgaatgaaatttcaagggaatttgtcccctctgggttccacttgaggttgtgccgatgctgctaccacactgtcgagcccaggtaagtcctactgcaggattttgtgctgtggccactcatgagtgtccctgaaataactttttttttttttaaatccagttttgggatcacgcaactttcctatttttctcccagtagtcagctcccttagttaacttgtcactttaatttgatatttttattttctctccttttaagtcttagagaccagcagagaatctgtgagagaaagtatttcaggaagttagaaattcaaccgaatctgaggtagtcctaaaaagtgccattttgtttcacttatgggctaaagtaccagcttagtcaggtaagagccctgacccacttcagatggtaacaccacttctcactgccttcagatggaatcacagatttcagtcacggcgcataacaaattgatcagtgagtggctaggcatctgcagataaattgtttcagccatagaagctccattagcacatatgcttccttttccccccttcctttaaaatcatctggaaagaaactattttgtgcccttggggactcctgtctgtctgttacagtttaccaagatggagctgggttaggaaagaagtgagggcccattttgtggttcaagtgcactagacagctgctggggtaggaagcacaggcaatgtctgtaatcagctgtgggagagcagtgactgagaacagtctgaggcctggctccacttggaagtatctggggtgcgatgaaatcacaattatcttgaagcctaaagagggaactacaagactgttaactaagatcaatgtgggcacctaaaagggtatgttaaaatcaccatttctcaggtcaaaatactgtgaataagtcttcaataaaatcactaatggtta

SEQ ID NO: 29839 - DNA, 2614 bp, Homo sapiens
acagagagattggtgtttttgtgaggcagtgagacctaaggtaacctttatcaaaaggatggagttgggaaaaggaaaactactcaggactggactgaatgcgttgcatcaagcagtgcatccgatccatggccttgcctggaccgatgggaatcaagttgtcctaactgatttgcggcttcacagtggagaggtcaagtttggggactccaaagtcattggacagtttgaatgtgtctgtgggttgtcctgggccccacctgttgcagatgatacacctgttctactcgctgtccagcatgagaagcatgtcactgtgtggcagctgtgtcccagccctatggagtcaagcaaatggctgacgtctcagacttgtgagattagaggatcactacctatccttccccagggctgtgtgtggcacccaaaatgtgctattctgactgtgttgactgctcaggatgtctccattttccctaatgttcactctgatgattcccaggtaaaggcagacatcaacacccagggccgcattcactgtgcatgttggacccaggatggcctgaggctggtggtggcagtaggcagcagcctgcattcttatatttgggacagcgctcagaagactcttcacaggtgctcctcctgcctggtgtttgatgtggacagccacgtctgctccatcacagcaactgtggactcacaggttgctatagctactgagcttccattggataagatctgtggcttaaatgcatctgaaacctttaatatcccacctaacagtaaagacatgactccgtatgctttaccagttattggtgaagtacgctctatggataaagaggcaactgattctgaaacaaattctgaagtatcagtttcttcttcctatttagaacctctggatctaactcacatacatttcaatcaacataagtctgagggtaattctcttatttgtctaagaaaaaaggactacttgacaggaactggccaagattcttcacatttggtccttgtgacctttaagaaggcagttaccatgacgagaaaagtcactattccaggcattctggttcctgatctgatagcatttaatcttaaagcccacgtagtggcagtggcttccaacacttgtaatataattttgatctactctgtcattccatcttcagtcccaaacatccagcaaattcgattagagaacactgaaagaccaaaagggatatgtttcttgacagaccaactattactaattttggtaggaaaacaaaaactcactgatacaacatttcttccttcttcaaagtctgatcagtatgccattagcttgattgttagagaaataatgttggaagaagaaccttcaataacatcaggtgaaagccagactacctactctactttcagtgctccgttaaataaagcaaatagaaaaaagttaattgaaagtctttccccagatttttgtcaccaaaacaaagggctgttgctgacagttaataccagtagtcagaatggaaggcctggaagaacacttattaaagaaatccagagtcctctgtctagtatctgtgatggctccatagctctagatgctgagcctgttacccagccagcatcgctgcccagacacagcagcacaccagaccacaccagcacactggagcctcctcgtttgcctcaaagaaagaacttacaaagtgaaaaggaaacttatcagctgtctaaggaagtggaaattttatctaggaacctggttgaaatgcaacggtgtctttctgaacttacaaaccgtctgcataatgggaagaaatcctcttcagtgtatccactctctcaagatcttccttatgttcacatcatttaccagaaaccttattatctaggtcctgttgttgaaaaaagagcggtgcttctctgtgatggtaaactaaggctcagtacagttcagcagacttttggcctttctctcattgaaatgctacatgattcccactggattcttctctctgctgacagtgagggctttatcccgttaaccttcacagccacacaggaaataatcataagagatggcagcctgtccaggtcagatgtcttcagagactctttttctcacagtccaggtgctgtttcttctcttaaagtctttacaggccttgctgcccccagtttagataccactggctgttgtaaccatgtagatggcatggcttgatatctgcagtgtccttgctgtgtagctcttcagatgagaccattacaaacaaggcctgcttgacactggacactcgccaatgagactcccactgcactcaggcgaagcgcttgccatggtcggctctcctggtttccccctgtttcccctgagctgaggctcgctgctgtgtagcagagctcagtctttattagatggctccgaaagtggtgtttatgtattcatgactgtgtggttttgactaagggcagaattctcagaacaaaacaatattatggcacctaaaagggtatgttaaaatcaccatttctcaggtcaaaatactgtgaataagtcttcaataaaatcactaatggttattgtggctgttttggatgttttggtagtatt

SEQ ID NO: 29840 - DNA, 452 bp, Homo sapiens
aagatggagagggaactccacccctcctcgttaaagacaggaataatcattcactttgcttagtggtccccaataaacaagcttagcagataagcgggaagacagggaaagggaatcagacttgggatccaggagctcgcaggaccctgttctgccccaggccactcaggaatggagagctgctagctggacctgggtaggtcaccattactcactggggcttttgtctggcatgaaaggtgacgggagaaaggggcagatttttatccaggcagccaccgtgggtgtggacactgagtaataaggaaagaaatgcagttcagaagcaaagagggaggagccaggtcctctgagctcttctgagaaaccagagcccagtcgagctctgcagctagagtggcagctgcggatgacagtgggtcagaagcttggtgggaggaggctgacccagc

SEQ ID NO: 29841 - DNA, 297 bp, Homo sapiens
tagtacagtgcactttatatgacctaactgatatataaagaataaggtactcaaaaatcaacaaatacacatcactttggaatggtatggaataattagtgaaatttaccacatagggggatcatacagtgtgtccacactatagattagcttcagatcttttatatccttactagttttttgtctgcttgctctataatgacacagagaccaacattaaactagttatgagtttgtttttccttttcatcctgtctcttttgtcttcctataatttcagtcatttttattagttac

SEQ ID NO: 29842 - DNA, 424 bp, Homo sapiens
tacaactaaattcgcggccgcgtcgacgttttagaaaaagacaaaaaaaaaaaagagagagagagagcgagagagcgagcgtgtgcaagaggttgcgagcggggccccgaggtgtccagagcccctgcaagtatgcactgagaaatttatctacaggtcgtttgacaaaaatgaacaatatcctatttattgtatatactgttttattataaatcgtggattgtatattgcattctgtaaacctgctgtggtcccgtggtgtgcaaattcgcatggtgggggggagggagaagaacctcttgcgggagctttttttttctttcttatttttcactcttttgggttttctcttctgttgttgttgttgttgttttctgttggcaggacacacccaaagatccaagtttgtattaaaaagaaatga

SEQ ID NO: 29843 - DNA, 2204 bp, Homo sapiens
agccctcgcccgagaactgtcggcagtttgcgggggcttctcagtggcctttccggcagggctatggaggcctggactgggcctcagaggcctttagtcagctctacaatcccagttttgactgccacgtcagcgagcccaacgtgatcctggacatctccaactacacaccgcagaaggtgaagcagcagacggctgtgtcggagaccttctctgagtcatcctccgacagcacccagttcaatcagccggttggtggcggggggtttcggcgtgccaacagcgaggcctcaagtagtgagggccagtcgagcctgtccagcctggagaaactgatgatggactggaacgaggcatcatctgcccccggctacaactggaaccagagtgtcctctttcagagtagctccaagccgggccgtggacggcggaagaaggtggacctgttcgaggcctcacatctgggcttcccgacatccgcctctgccgctgcctcaggctacccatccaaacggagcactgggccccggcagccgcgaggtggacggggcggtggggcctgctcagccaagaaggagcggggtggcgcagcggccaaagccaagttcatccccaagccacagccagtcaacccactgttccaggacagtcctgacctcggcctggactactatagcggggacagcagcatgtcaccactgccctcacagtcgagggccttcggcgtgggagagcgagacccctgtgacttcataggaccctactccatgaacccgtccacgccttccgatggcacctttggccaaggcttccactgcgactcgcccagcctgggtgctcccgagcttgatggcaagcatttcccaccgctggcccacccacccacggtgtttgacgccggcctgcagaaggcatactcgcccacctgctcgcctacactgggcttcaaggaagagctgcggccaccgcccacaaagctggctgcctgcgagcccctcaagcatggactccagggggccagcctgggccacgcagctgcagcccaggcccacctgagctgccgggacctgccgctgggccagccccactacgattcccccagctgcaagggcacagcctattggtaccctccaggctcagctgcccgcagcccgccctatgaaggcaaggtgggtacagggctgctggctgacttcctgggcaggacggaggccgcgtgcctcagtgcccctcacctggctagcccaccagccacgcccaaggccgacaaggagccactggaaatggcccggccccctggcccaccccgtggccctgctgcagccgctgctggctatggctgcccactccttagtgacttgaccctgtcccccgtgccgagggactcgctgctgcccctgcaggacaccgcctacaggtacccaggctttatgccccaggcgcatcctggcctgggtgggggccccaagagcggcttcctggggcccatggcggaacctcaccccgaggacacattcaccgtcacatccctgtagtgccaactgaagtgccgactggaccgcgaggttttgttcctggctttcagaaaaccaacgccaagatccctcccagcgtccacatcgtcctctggcaggagctcctgcccctctgcctcccaccctgccccctacaccccctgcagacccatctccctccaccccctcccacccatctcctccacgcagaagccgaaggtgagccctttctgcacaaaaccagcaattgtaaatactttttaaaaatgtacaaaacttaaaaacaaaacacagttttagaaaaagacaaaaaaaaaaaagagagagagagagcgagagagcgagcgtgtgcaagaggttgcgagcggggccccgaggtgtccagagcccctgcaagtatgcactgagaaatttatctacaggtcgtttgacaaaaatgaacaatatcctatttattgtatatactgttttattataaatcgtggattgtatattgcattctgtaaacctgctgtggtcccgtggtgtgcaaattcgcatggtgggggggagggagaagaacctcttgcgggagctttttttttctttcttatttttcactcttttgggttttctcttctgttgttgttgttgttgttttctgttggcaggacacacccaaagatccaagtttgtattaaaaagaaatga

SEQ ID NO: 29844 - DNA, 743 bp, Homo sapiens
tcaagcttctaacgatgtacggggccatggcggaacctcaccccgaggacacattcaccgtcacatccctgtagtgccaactgaagtgccgactggaccgcgaggttttgttcctggctttcagaaaaccaacgccaagatccctcccagcgtccacatcgtcctctggcaggagctcctgcccctctgcctcccaccctgccccctacaccccctgcagacccatctccctccaccccctcccacccatctcctccacgcagaagccgaaggtgagccctttctgcacaaaaccagcaattgtaaatactttttaaaaatgtacaaaacttaaaaacaaaacacagttttagaaaaagacaaaaaaaaaaaagagagagagagagcgagagagcgagcgtgtgcaagaggttgcgagcggggccccgaggtgtccagagcccctgcaagtatgcactgagaaatttatctacaggtcgtttgacaaaaatgaacaatatcctatttattgtatatactgttttattataaatcgtggattgtatattgcattctgtaaacctgctgtggtcccgtggtgtgcaaattcgcatggtgggggggagggagaagaacctcttgcgggagctttttttttctttcttatttttcactcttttgggttttctcttctgttgttgttgttgttgttttctgttggcaggacacacccaaagatccaagtttgtattaaaaagaaatga

SEQ ID NO: 29845 - DNA, 2239 bp, Homo sapiens
agccctcgcccgagaactgtcggcagtttgcgggggcttctcagtggcctttccggcagggctatggaggcctggactgggcctcagaggcctttagtcagctctacaatcccagttttgactgccacgtcagcgagcccaacgtgatcctggacatctccaactacacaccgcagaaggtgaagcagcagacggctgtgtcggagaccttctctgagtcatcctccgacagcacccagttcaatcagccggttggtggcggggggtttcggcgtgccaacagcgaggcctcaagtagtgagggccagtcgagcctgtccagcctggagaaactgatgatggactggaacgaggcatcatctgcccccggctacaactggaaccagagtgtcctctttcagagtagctccaagccgggccgtggacggcggaagaaggtggacctgttcgaggcctcacatctgggcttcccgacatccgcctctgccgctgcctcaggctacccatccaaacggagcactgggccccggcagccgcgaggtggacggggcggtggggcctgctcagccaagaaggagcggggtggcgcagcggccaaagccaagttcatccccaagccacagccagtcaacccactgttccaggacagtcctgacctcggcctggactactatagcggggacagcagcatgtcaccactgccctcacagtcgagggccttcggcgtgggagagcgagacccctgtgacttcataggaccctactccatgaacccgtccacgccttccgatggcacctttggccaaggcttccactgcgactcgcccagcctgggtgctcccgagcttgatggcaagcatttcccaccgctggcccacccacccacggtgtttgacgccggcctgcagaaggcatactcgcccacctgctcgcctacactgggcttcaaggaagagctgcggccaccgcccacaaagctggctgcctgcgagcccctcaagcatggactccagggggccagcctgggccacgcagctgcagcccaggcccacctgagctgccgggacctgccgctgggccagccccactacgattcccccagctgcaagggcacagcctattggtaccctccaggctcagctgcccgcagcccgccctatgaaggcaaggtgggtacagggctgctggctgacttcctgggcaggacggaggccgcgtgcctcagtgcccctcacctggctagcccaccagccacgcccaaggccgacaaggagccactggaaatggcccggccccctggcccaccccgtggccctgctgcagccgctgctggctatggctgcccactccttagtgacttgaccctgtcccccgtgccgagggactcgctgctgcccctgcaggacaccgcctacaggtacccaggctttatgccccaggcgcatcctggcctgggtgggggccccaagagcggcttcctggggcccatggcggaacctcaccccgaggacacattcaccgtcacatccctgtagtgccaactgaagtgccgactggaccgcgaggttttgttcctggctttcagaaaaccaacgccaagatccctcccagcgtccacatcgtcctctggcaggagctcctgcccctctgcctcccaccctgccccctacaccccctgcagacccatctccctccaccccctcccacccatctcctccacgcagaagccgaaggtgagccctttctgcacaaaaccagcaattgtaaatactttttaaaaatgtacaaaacttaaaaacaaaacacagttttagaaaaagacaaaaaaaaaaaagagagagagagagcgagagagcgagcgtgtgcaagaggttgcgagcggggccccgaggtgtccagagcccctgcaagtatgcactgagaaatttatctacaggtcgtttgacaaaaatgaacaatatcctatttattgtatatactgttttattataaatcgtggattgtatattgcattctgtaaacctgctgtggtcccgtggtgtgcaaattcgcatggtgggggggagggagaagaacctcttgcgggagctttttttttctttcttatttttcactcttttgggttttctcttctgttgttgttgttgttgttttctgttggcaggacacacccaaagatccaagtttgtattaaaaagaaatgaaaaaaagcaaaaaaaaaacaaaaaaaaaacaaaaa

SEQ ID NO: 29846 - DNA, 160 bp, Homo sapiens
ccctcaccctgctgaatcctgggaggagctgggtgggggtctccctcttcacttccctgatctcagagcacagtcgatgcgtgccgctcactcctgcctcttctcttgtgtttctttgcagctttcagaaaaccaacgccaagatccctcccagcgtcca

SEQ ID NO: 29847 - DNA, 490 bp, Homo sapiens
tttttctttttttgagacggagtcatgctcattgcccaggctggagtgcagtggcacgatcacagctcactgcaacctgtgcctcccaggtcaagagaatctcctgcctcagcctcccgagtagctcggattacaggtgcatgccaccaagcccagctaacctgtatatttttagtagagatggggtttcaccatgttggccaggctggtctcaaacttctgacgtcaggtcacctgacctcccaaagtgctggaattacaggtgtgagccaccatgcccagcctataaacattttttttttattaaatagtcaatcattatgataaagaacaggaaaggtaatgtttaggtatccaaagtccatgcatgaaagatgctaattaccagccccaggcaacataggctgaagaaagttagttctagcacccagtgaagctagctattgaccatggaacactgggtatgttagtttgtccatgtctcagatgc

SEQ ID NO: 29848 - DNA, 619 bp, Homo sapiens
attcctcgtgacttggttttctaagttaaaccaccttttcttgcctccttcttcttctcagaatgaatctgtgtaattggatgtgtgaggtatgcttagttgccatttacctaagtctgtttccaaaaatgaccgaacaaaagactattacaagagaagaggcccaaacaaaccctgtagttttaacaaatttccttttctcctcccttcttatctctctcactctcttttccactttcttctctcctctgtctttagctagttaattacatatctagagttaaaactcagggtttccgagtcatgtgtccttggtgtgcagtcattgggtgaggagctggggacgtcaaaaatgaatttaacgtagtccctcctctcaggcagctgcaaactagaagcaggcgtgggacacactgtatgcccaggagtggctttgcatttgagagccatccttctggcagctgtgcagggaatgggtcgacctggccttgcattttcctcactcccctcctggcccactccagcagctggtaggcaaagctgtaaaggaagtaatgatgtggctcaggaaagaggcatgaggttaaagaaaaactgtggcaagggtagcagagatgga

SEQ ID NO: 29849 - DNA, 331 bp, Homo sapiens
attatgactttgcacaaattagaaagataatctttaattttcaagcaactactgtgaaatcaataaatattacctatttcacttttacatcctctgatggggttaaaatataagatggctgtcttagctgattgttttccctgttagctactagaaaagaataatttgaattttatgaataaaagagacaagaaacattttttcctgaggaagaacatttgttattcctttttaaatatcttcatttaaatgattatgtattacaataaatgttaagtatgggtatattataaataatacaatgattaaaaaatttatctcttgaatcaca

SEQ ID NO: 29850 - DNA, 413 bp, Homo sapiens
gccacccctatgcatgggttccttcggcctgaccatcactatgtccttaatgtgctgggccttgctaccactgctgttttcagttaaactctcttgggtgctaaagttatggaggcacctcaaatcagaagttccaggtttgaggaagagagagcagaaagatatgagatcccaattcttgcataggctggaatctggtgggacaggagttgtaaaccaatgccactgtcctttgttatctgtgggggattgatttgaggacccctgaaggaccaaaatctgaggatgcttaaggccctgatataaaatgacagagtattttcatataacttatgcatatcctcccatatatttaaatcatctctagatcacttgtaactaataaaataaaaatgctatgtaaatagttgcta

SEQ ID NO: 29851 - DNA, 6196 bp, Homo sapiens
tgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcagctgctggccaacgcagtcatcttcctgtgtgggaacctgacaggcgccttccacaagcaccaaatgcaggatgcgtcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgtactacacctgcagctgtgtcctgggcttcatcgcctgctcggtcttcctgaggatgagcctggagccaaaggttgtgctgctgacagtggccctggtggcctacctggtgctcttcaacctctccccatgctggcagtgggactgctgcggccaaggcctgggcaacctcaccaagcccaacggcaccaccagtggcacccctagctgttcctggaaggacctgaagaccatgaccaatttctacctggtcctgttctacatcaccctgcttacactctccagacagattgactattactgccgcttggactgcctatggaagaagaagttcaagaaggagcacgaggagtttgagaccatggagaacgtgaaccgccttcttctggagaacgtcctgccagcccacgtggctgcccactttatcggtgacaagttaaacgaggactggtaccatcagtcctatgactgcgtctgtgtcatgtttgcctccgtgccggacttcaaagtgttctacacagagtgcgatgtcaacaaagaagggctggagtgcctacgcctgctcaatgagatcattgccgacttcgacgagctcctactgaagcccaagttcagcggcgtggagaagatcaagaccatcggcagcacgtacatggcagctgcagggctcagcgtcgcctcagggcacgagaaccaggagctggagcggcagcatgcccacattggtgtcatggtggagttcagcatcgccctgatgagtaagctggacggcatcaacaggcactccttcaactccttccgcctccgcgtcggcataaaccatgggcctgtgattgctggagtgattggggcccgaaaacctcagtatgacatctggggaaacactgtcaatgtggccagccgaatggaaagcactggagaacttgggaaaatccaggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctggtaaatgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcccaaggaattgaaagtcaacctaactgtaacaacagggtgagaaatgaccaaactgcccgtgactttttctgaatggacttcataaccggaagacttaaccggtggcctcatcaccagagcatcgccaggatttctaatgcactcagtttccctacatagcagggattcttagctaggtgtccccatgaaccccgtaaagttctacacaaagtcttgcatacaggagcctttacaagatgattatacagggttgcagattgggtgactgaccagacttgttggggtcctgggatgagttgccccgggctgcaaattaagagtacagctaagtgcgggggtggcggtggagggaacgaaaattgaacctgtctgcctgtgctgtgtcgtgtggctttatcagcccgaggaagggcaggtgtattctaatttgcacaaaggtgctgggtagactagtggcagctctcatgtgctgcacataagtggaatcagtatgaatagaagaacttgctgtataaaggaatttcatggcaacaatgctggtaagggcaattagcctcgcttaagttgccttttttacacaccaaaactttttacatgaagggctggtttcacatgaatactatactgaaatctgtgccacaccaaaactttttacatgaagggctggtttcacatgaatactatactgaaatctgtgctctcaagatctagcagtgaccagggctgcccggcgggggctctcctggcaagtcaggaaggtttctgttgctaatataacatagaaacacattagtgcactgggcctctctgaggtcagcatatttgtactcttggaatatttgtttttttcttcagtaacaacagaaaccccagttgggagtttaacaaataactgactaccactcactcatgcatttttatttccaattaaagcaaagcactgtgctgtgctcagataataatagtttgtaagtaaaagtttttagttttcagtgttcaggttatagaatataactgaccataaaaattacctgcaggtattttctttttatgaacttgtttttaaattaccaagtaattactggtgtcattttgttttatgacagacacacgtatctaacaaacaaacaaacagtgaccttctccatgggtcaaggacttccttacaatttctcctgagttaacttttgtgaaaataatacctaaggttttctggcttattgaggaaatttcctaacaaacaaacaaacaaacaaacagaagagaagatcattaaccactgtatactttgtgtatataataggtcagtgtaaagaaatatgatttgaggtggtgcatgcaagtaactagggtttattctatataatgaatatttatagatctgtaacatttgtttcaaaatgctgtttcatttttataaagtaccagtgtttagctgctttttatacattaaattagcaatttgaaaaactc

SEQ ID NO: 29852 - DNA, 382 bp, Homo sapiens
tgagacagtgtctccccccattacccaggctgaagtgcagtggtgccatcgtagctcactgcagcctcaaactcctgggctcaaaccatcctcccgctttagcctccccgtgtagctggggatacaggtgtacactaccaaacctggccaaaacttttaaatgtatcaccaaattgccctccaagtgaagttacacatatgtacactctcatgagtgacatttgagtggctatttccccatgatctctccaacatcggttattgtgattttttaaaagaccttgccaatgtcataggtaaaaaaaatagcatatcattgtttgaatctattgttattttcattatactgttttatttctggtagaatgtaaaattgcataca

SEQ ID NO: 29853 - DNA, 374 bp, Homo sapiens
gggtgaaaccctgtctccactaaaaatgcaaaaattagctgggtgtgatggcgcgtgcctgtaatcccagctacttgagaggctgaggcaggcgaattgcttgaaccggggaggcgaaggttgcagtgagccaagatcacgccactgcactccagtctgggcgacagagcaagacttcatctcaaataaataaataaataaatattccgccaaattgttgactcctttttgtgattgtaaatgctagaattaaataattatttctgatctgtcaagttaaaaccctgagtattatcttttaatatacatatatatgtttatgtgtgcataaatatacgatagctttttttttctttcgatctgctactgaaata

SEQ ID NO: 29854 - DNA, 664 bp, Homo sapiens
cacagagtgggaagggaaggtgagcaaaggcaggaaatgaagaagctgaggctgagccaagggtcccaggggacattaagggggttcagcagacctgccctgctgtaaagagaaaagtggcagtgctcctgttcccagccctgtccctcctgttctccctgcagtcagtagagcctccctggtgggaggaaagtgaggacagagcagaggtgtacgttctgagagcacgcagctgcatagagcccagcaggggggctggttcacaggggtcccctgtgaacagatgctacattgcatgcacatatcttgaccaaaggacagagccttcctgtgaattagaaaaaggactctccgggccaggcacagtggctcacgcctgtaatcccagcactttgggaggctgaggcgggtggatcacctgaggtcaggagttcaagaccagcctgacaaacatagtgaaaccccatctctactaaaaaatacaaaagttagccaggcatagtggtgagcacctgtaatcccagctactcaggaggctgaggcaggagaatcacctgaacccagaggcagaggttgcagtgagccaggatctcaatattgcactccagcctgggtgacagagcaagactttgtctcaaaaaaaaaaaaaaaaaaaaaaaaaaaa

SEQ ID NO: 29855 - DNA, 130 bp, Homo sapiens
cagtgcaactcttcccaaactgcttgactagctttagaaaggggctaaaaaaagcttttgtgggctttttgttcttcctctgggtagctatacttactcgcctacctatacttactccccctacctccac

SEQ ID NO: 29856 - DNA, 595 bp, Homo sapiens
actttcctggatgtggcctgaacctttctatccaggcctaacttagacactggtcatggggtattccaagaaagtcatggggcaatgcagccctctacagctgagatagaccctgaaaaatttgacagcaggagatggtttgctgaccctcactcctcacagcagggcagcaagtttttcccattattaatatgaataattatcctatgttatcctagaaattgaatccctcccatcactggggaaaagggaggggggactgagaggtggatctccttattcatcacagcatctagggttccaacaatcttcagtgcttgagaactcaagggcctaggatcagtgcaaattgttctcgaaacctgctgattctcctcagattataatgactcaggtaattcatgacttgacatttcactttgacaatttacagatttatagataggtagttcttggttgacctgggcctgttgtggcttatccatggcaattttgaattaaggctcttataaataaatttaaatagagttcatgcttaaatttcttttaatcctcacttacgaaattggaaagcagaaataaaagtaagcttaga

SEQ ID NO: 29857 - DNA, 467 bp, Homo sapiens
actctcaagagatcagtattttatacctaaagatgctttcttggagtggtataggcatttagaacatgaatgttctaaaactgcactatctaatatggtagccacaagccccatgtggcaaactgcaatccagttctttggtctacaagtcacattcaagggctccacagacacacaaggtcagtggctcacactgcacagcacagagaccctttccaccaccaaagaagctctcgaacagccctgctctacaaggcaatgtgccaccccagcaggctggctgcccaggggcttcttatgacagactgccttgcccatgaattacagtatcatgattttcaccagcaggcttgcaagccagcaagcatggagcacatgcacacatacgcaggtccaagcacacgtctgtctctaaccatgccttcaaagtataaaatgactttgtaatttgggaactatatatatga

SEQ ID NO: 29858 - DNA, 474 bp, Homo sapiens
gttattttaaattctttcctttgaaatgaatgctttgctgtttccacattttctgataatcagaaatatacttttccagacctcttcctaaagcatgttgattttaaggtctgcaccagacctctgttctgctctcgactgttgaatatgtctggcttatttaaaaaaaactgtgtttgcccatagaggggcagggaactggggaggagaaggtagttaaggtaggattctgactccaaatgagctgattaaaaggtatctgagataattgttttcaaaggtggaaagagatggctggaaatcaatgggcagtcatgttggaatgtaaaagtaatcaacatgaacacaggccatatcatcaatgctttctgaatgcaaagggaaagggaactactatgccgtggcttccttcaaattgatgtgtctttccaaacttagaggagcaagagaaatgcttgcagggactttaacttg

SEQ ID NO: 29859 - DNA, 472 bp, Homo sapiens
ttcatctccttgttcttgtgtatttttgtacctcaaagctctttggaggattctctttggagggagacccacaggatcaagtgagttagggtggtgattgatttagtcaggttttataaaccagtattctctacttcacgtagaattttcactgtgcttgaatagtcttaacatcttattcagagaaaaggcttacattgattaatgtggcatatgtgtggttatcatacttagaaagtgctctgtttaaggagagctttgtcaagagcattctttcaatggagtcacgagaaagctttttaaaaaagctgacaacttcaagtacaatttcctttttcttctgtctattatgattgaaacccaatctttgttataacataattatctcagctgaagccaacagggagttgctgccttaatgtaaggggtgtgaagtcccctaaataaatagaggattaattacattcccagc

SEQ ID NO: 29860 - DNA, 486 bp, Homo sapiens
aaaccacctacatccctgagcctctgtcctcttaaaacccaggctgatagcaacagaaagtgaaacaccacatgttctcactcatatatggaagctaaataaagttaatctcatagaagtaaaaagtggattcgaggatactagaggctgggaaggctagggggaagggggcagttaggaagagattttgtaaaggatacaaaattacagctagataggaagaataagtctagtgttctatactattaggatgactacagttaacaagaatatatgtttcttgtgtatgtgtgtgacaagagtctcactgtgtcacccaggctggagtacagagatcttggctcactgcaacctctgcctcccaggctaagcgattcttctgcttcaacctcccgagtagctgggattacaggcatgtgccaccatgcccagctaatttttgtagttttagtagaggtggggtttcaccatgttggccaggctggt

SEQ ID NO: 29861 - DNA, 314 bp, Homo sapiens
ccatatcacatggtttaaaatttaaaacaataaggactcataatgcaatagaaaaattgagaagaggacttagataccttgaaaaagaggtgaaaaggttctcaacatcattaattatcagggaatcacaaattttattcacattgcaacactactatccaaacagtagaatgaataaaattaaaaagacagaatataccaagtgtgagtgaggatttggagcaacaggagctcttgtacactgctcatgggagtgttgattggttcaatcaattttgtaaattgtatgtcagtatctattaaaattgtagata

SEQ ID NO: 29862 - DNA, 386 bp, Homo sapiens
caagatccttagctttatatatatctgctgccacgtaggtaatattcacaggttctgggtattaggatgtgaatatatcattggaggggccattttcttgcctactacagacacttaacaccatagattagtaaataatataatatgggccaggcgtggtggcttacgcctgtaatcacctgaggtcaggagtttgagaccagcctggccaacatggggaaaccccgtctctactaaaaaatacaaaaattagctgggcgcagtgatacgtgcctatagtcccagctacttgggaggctaaggcaggagaaacgcttgaacctgggaggcagaggttgcagtgagcagaaatcatgtcactgcaccctagcctgggcaacagggcg

SEQ ID NO: 29863 - DNA, 461 bp, Homo sapiens
cactggcttccatccaggtagtggatggaagctgggaagaatcttgagactgttagcggaggcctaaagggtattgaggaaactgtcagcacaggctttaatgttattggaagctgagggtaaggatatgcttgttatatagtggaagaaagtttggcaacatcctcacctataataatatggaaaatagaaaatgtacctcatgaaccagaggatctagctaaggagatatccacgcagaagtcaaaggtactcttaatacctggcttctacctgcttaaataaaatgagaagagagacagcctaaaattcgagaagttaaatataaatcagtctggacttgctaggttcagcattaagtttattttctccgttctcaacctggggaatcatcaccccgcatggcagatggttctaaaactgggcaatggcttgtgagcaaaggtgaaatccaagggtgc

SEQ ID NO: 29864 - DNA, 1115 bp, Homo sapiens
gagactctctgttcttggccatgtctttgaatttctgaggaagtcttttttgtttgtttttgtttttccctggtctgatgtacctggagagggaattagcctcacacccagttagggaacaaaaagccaagtaaacaaaagaatgctgttccaccttcctccagggaactggcgcccatagctgcaggcacaggtgcccagcccgctcactggcccagcaaggtgcttggtctcaggcccccagagcccgtcctggagccgcaaacatgctcgctattatccatggaaaaagagaggcattctctttgtttatagtctaagccaagtcacctgattcactctcactactctgcagtttggaattgtaaaaagcaaaaggctacaaaaatcaaaaccatccacctatgtaatgaaccatttcttatcacagcccaggaaggcacagataggaatcagtgtgcgtaagctctccacgtggaaaccctgtgaaaacagcagcctttcctaagcatctggctcctaggagctggatgttaattgttgctaaagcctgggttcattactacaaaagaaaataaacattccagagtcattttgaaagcattttgattgttctagaatattcacccaaggttgagcgtctcatggtgcatggcaggttcggccaggagctggccgtggcctttccactcctttcctgccatcctgaggatgcagtgcctggggcctcgcagttctctttccactcaaatctaaggctctaaagcttcaacaactgtcctgggacaataagaagcgctgagtccccatcctgcctgctctcctttctactcagtggggaaattggatcactcgccttggtggatcactcgccttggggaaaagccttttacgtcactgaatacatccccttctacggttttcatccaacagtcagccaggctgctgcagcacacataaaaacttcccctgcctgcaaagagctccaagtaggtgggaaagagatggatgtgcggacaggcttaacccagcaaagactggcggaggggtgtggagacagtggtcaggggtgggttcccgggggtactgatgcccaaaataaaatgtcaaggacg

SEQ ID NO: 29865 - DNA, 312 bp, Homo sapiens
ttgcagagtaggaaatttttaaataggttgtatatatagtaggatattttgcaactattaaaaatcatgtggactagtattacatgggaaaaaaagcagattataaacagcatatatagtatattttataaaactacatgttaaaaatgtactttacacataaagaacaaaaatgtatgggaggccgtttgttttagactgacctgcactaggcaccagcagaccagacagaattagaatggaggcccttgtgctgagtgccacataatcaaactgaactttgaatttgaactgaaatgagccagttttcta

SEQ ID NO: 29866 - DNA, 639 bp, Homo sapiens
aaaatgtacttagaaattttaaaagcacaaaacaaacgcattctctccccatcctcctatctccagctcttagagactggagctcagcacctaagctgttaatgaatggggacagctttcatctccactggaaaaaagcctgctctctcacttggggtccctctcccccttccacttgcattcaatcagcacccatgcaaccatcctccctgctctgagctctgtgagcccctgaaaatagagaaattgggtgtttgtggagcaaaatatagctaagtaatttttcctgctcctttgaggccatgttctttcatggtgagggaggggcagagaaaatagaggctcacaaatcccttttcctgtgactcccacaacttaggccagggctttctttgagcctcataatgtgtgtgtgtagataggggaaaggaggtccacttccagaattttccctgtgttcttattcctcacttatgctaccgttggctcagctggcccgaaccaagatccatagccaggtttccatcactggatgagctccccaaaacagggtgaccttcccctccttcgtgggggtaagggaaagctctcatatcattggacttcaggcaggaagggtcagttggaaagaaacctttg

SEQ ID NO: 29867 - DNA, 586 bp, Homo sapiens
cttaaacagctactcagccacattcatgaggagagtggtgcaaatcaagctagacctaaaacttttgcctgttagactggtgggggtgtggggaattggtgccctcatgcattgctggtaggagcgtaaattgatggcaacttcactggagaacaatctcggagtatctatcaaaactacgtatgcaccttaccctttgacccagcaattctacttctagggatttgtcccacagatacactcacttctatgacattatgtctaaacagatttattgcaggcttgtatatggtactgaaagaccaggccaggcacagtggtcacgcctgtggtcccagcattttgggaggccaaggcgggcagattggctgagctcaggagtttgagaccagcctggcaacatggcgaaaccccgtctctactaaaaatacaaagtcaggtgtgatggtgcatgcctgtaatcccagctactcaggaggctgaggcaggagaatcgcttcaacctgggaggtggaggttgcagtgagccaagattgcaccactgcacttcaacctaggtgacagagaaagactctgtctcaaaaaa

SEQ ID NO: 29868 - DNA, 529 bp, Homo sapiens
ccctttaccacatgccaaccctgaagggctccgtattctcttgccagactggacaaccttgaacttgtgaggcctcttgcctgtgcacatgctgctgcttttactgggataagactgactcccacacatgcctgtggatgtacctgggtgctacctcctttggaaagccttccctggccaactgcaacctccttgcccaggttgccatggtgcttcccactattattttttatttttatttttattttttgagatggagtctcattctttcgcccagactggagtgcagtggtgcggtctcagctcactgtaaactctgcctcccaggttcaagcaattctcctgcttcagcctcctgagaggctgggattacaggtgtgcaccaccatgcccagctttttttttctttttcttttttaaaatttttagacggtgtcttgctctgtcgcccaggtggaggttgcagtgagccaagattgcaccactgcacttcaacctaggtgacagagaaagactctgtctcaaaaaa

SEQ ID NO: 29869 - DNA, 286 bp, Homo sapiens
ttcctgagcatatttatatactgggttgtgttgcaataaaaaaaaaaaagtttgaaatgcattgtcctaggttttagtctgtgaagcagctgagaccagtattctttttttttttttttttgagacagggtctcgctttgttgcccaggctggattgcagtggggaagatcttggctcactgtagcctttgcctcctggattcaagcgattcttgtgcctcagcctccagagtagctgggatcacaggcacgcactaccaacgcctggctaatttttgtgttttta

SEQ ID NO: 29870 - DNA, 278 bp, Homo sapiens
gttgtttttttttttaatggccacatctaagaaatactacatgattagtcaatctagaagcctactgccaaggactgggtgaagttcagagtgcccagagtttataaaactttcattgtcaggtgaaccagtgtgcaagcccacagtacgcagcacaactgtcaatgcaggtcaatgagaaaaggtggggaaggaaagagaaagttactacttaccctgtgcccttcaaacatgcctcccacctctacgtaagtagaatgcatttgttactaaaaatt

SEQ ID NO: 29871 - DNA, 223 bp, Homo sapiens
atctttttggagaggaggctagggagatgtgccagtgtccctataaaaagtccccagggtctcctgatttcaaggttcctctctcctgtgatgcaacgtactgtgtgcacaggcaacatttggcccacatcacattgccctaaggaattcaagcttagggaaccagcacaagatactgctctggctgatgcttttgctgtgaataataaaccatgtgttcgtg

SEQ ID NO: 29872 - DNA, 370 bp, Homo sapiens
taaaaactaaacaagaaggggtatgatttttactgaaggttttgctagtccctgcccccccgcccccgccccacacacacacccaggtcatattgatttgtcacctgtcagtgtctgctccaatgtaaaacacacactattttaatatattttctctcaaatttagtgttactgttttcatgtcagggataacattctaagctggaagactaagaattaagacatatactatggtgatcccaatagcaaaattacttggtgtgctgttctagagaacgctgaatatttatcagaaagagcccagggaaatttagaagtccttgtttcaggctctgtgttcagcccagaaaatttggtacaaggaaaacca

SEQ ID NO: 29873 - DNA, 960 bp, Homo sapiens
tttgggcatgtttttcagacgtttttgaaatatttatgataaatgtttgaagtctgttaaatccaacatttcggctcacttggaatcagtttctgttgactatcattttacctgcagagggtcaagatttcctatttttttcttgtctagtggaaagttggacatatgctgtagtgagtctgaactcttgtgttcttctgaggattattgtgtttttattgtagcagactgttaataaactgcttggtcaaactacacactttgtttttcctgtgatatgcagccgcttgtagctctcctctgctcttaggtctttgcactggtggtggttttagtgtggcaccctgtgagtctcccctgtgtctgcaaaatttgaaagttggctaaggatctgagtagagatggacttttctctgtggttgtctttattctggggattcccctagtttctagcactccaccagctttgagctctgtactctgacatttcaagctttatgccgccctagcttgagcatagttgggaaagagcatcatattcacagatttggctccatgttactcttttttaaaaatattgctttctggtttctgactgctttttcaccgtgctgcttgtggtttcctcagcacatatgtagtatgtaagttccagctgtcagctagggatttccagcatcttatgctctgaatttgagtgtcacctctatattctagtgctgtcagagtgctttaaatttctagctgcttccccaattccagattttgatatctggcacctttagttggtgaggaactggcttttgtttgcccccatgttttgcagcaatagctgtgggagttgagcagtgccttgagccaagatgccacaaactcacaattcttaacccttctagttacagtttttgagatttaactctcttcctggcttttgcaaatactacctttagatcattgaaa

SEQ ID NO: 29874 - DNA, 590 bp, Homo sapiens
atacactactgctgcagctcacaaacacctctgcatattacatgtacctcctcctgctcctcaagagtgtggtctattttgccatcatcacctgctgtctgcttggaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataatggttttcaaaccagtgggcacacagagaacctcactctgtaataacaatgaggaatagccatggcgatctccagcaccaatctctccatgttttccacagctcctccagccaacccaaatagcgcctgctatagtgtagacagcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagttga

SEQ ID NO: 29875 - DNA, 418 bp, Homo sapiens
agatcttctacatgcttgctgattgtgaaatttttgtccaataattctatcaattgctgagataaggctgttaaaacccacaactataatttattattttttagttctataatttttctcttcatgttgtttaagactttgttatttggtgcatatatatttggaattgttatgtttactggtgaattgatccatttattattagtgttgcagtctcctcactccttaatttagtgaggtccaagatcttgtcccacaaccaagagaataaggcacacaaataccagagagtgagtaaggcaaattaacattcattaagcaacagaaaagctctcagcagcaagagtggacccaaacaagggttgccagaaatggggctgagttctgatccctttatgtgacagaaacaaggaagtcc

SEQ ID NO: 29876 - DNA, 85 bp, Homo sapiens
catgtgttggtagagcagctgttccgtgctgtgctggaggtccacttcagcccccggttgcctcagacactctgaaacctgaagg

SEQ ID NO: 29877 - DNA, 3827 bp, Homo sapiens
  misc_feature (263)..(263): n is a, c, g, or t
  misc_feature (286)..(286): n is a, c, g, or t
aatgcctagcttttaaaaatttaattaattgcctatttttgagacagagtctctctctgtcatctaggcttgagtgcacttgcgccatctcagctcactgccacctctacctccccgggtccagccatcctcctgcctcagccttcccagtattctggggcacaaggtgtgcgtccccccgcccggcttaattttttgcctttttttttttgagacggagtcttgctctgttgcccaggctggagtgcagtggtgcgatctcngctcactgcaacctccacctccngggttcaagcgattctcctgcctcagcctcccgagtagctgggattacaggcatgcgtcaccacaccaggctaattttgtatttttagtagagatggggtttctccatgttggtcaggctggtctcaaactcctgaccgcaggtgatccacctgcctcggcctcccaaagtgctgggattacaggcatgagccaccgcgcccggctcaggcagggttctttataaaaacagcctgatgcctgaaggacactctctggttgtaatatttgtttcatccatgaagtgtttaaatattgcaactgacttgcgattagccaccaaaacaggcccttttagatgcagtgcctctccgaccaagtattggatgattcatacgtaatggactatgatcattttctgtccatgttttctattactatatgctggtttttttggagcaataagattactttttttctgttctattttgagcgaatcctttacagtttttgataagaactgtgacatttgttctttgttgataaaactcctgaaaataactcacaaggccagtgctgcactctggcacatgtaggttgttttgagggtttgttggttggttggttggctggttgattggttggttggtttagaacactaatgtacttgttatgaaccaaactctggtcttacagtcttaaattccacctcatggggctgttttctctgttagcaatgaaacctgggccaggtgtagtggctcacacctataatcctggcactttgggaggctgaggtgggaggattactggatcccaggagtttgagaccagcctgggcaacatagtgagaccctggtttctataaataaataagataatcaaaccagaaagcaggcattttagtaacagcctgttgaattttaaggtgaatcaaggtaattttgcagaatgcgttcttgcaccgaaatgtccctgaccacatatcagtggtatagactgaacagtgtgcttcagggtcatgtgctgagtgcactgatcactctgctgtggcccagggcatctgtacctgttggacaagattatgataattcagaagtgaagtaaaatgcctccctctgatggcaaaaagccaacctgtttgcaaaatcacccttattgaagggtggcatggctgtggtccctccctcctgttacttgcatcaccaaccaaactaaaccaaaccatacctgggcctgttcagctggacttgaaatcagtttcctttttctctcccctttgcagcacttttcagtttccagctttgtcattctgtggcctttgctgtgacaatgctgggaagggttagaaatcctgtcacctccatccacaaaggcacagttccacgccctgtgataagatatcccctcttctctcccagactgtctccttaagcctttcaaactgagccccttgctgttggggtaatcacccttaaggccgccttgatgcccctctctccaatcaagtccaatagtagcattaactgagaagcactacacctgactggcttcactgaagcttaagtggttgaggatgaatcttcggtgtaaaatcttttactataaggatatattttaaatatttcatatcccatcaagttggaggttaattttatccatcacaatgagtcatgatttgttgcacccaaaaggagcagaaacacaggtgatgagatatgggaggtggcaccatggtgctttggaggcgttggtaagatgtgaccctctgttgcctatgcccataaaccagtggtgggagtggccatggagtagatggcaggggcttgttgaagggattgaaagctctcctaggctaggcatggtggctcacacctgtaatcctagcactttgggaggctgagatgggaggatcacttgaggttgggccagcctagccaacatgataaaaccccgtctcgactaaaaatacaaaaattagccaggtgtggtggtacacgcctgtaatcccagctactcgggaggctggggcaggagaatcgcttgaacccaggaggcagaggttgcagtgagctaggatcacgccactgcactccagcctgagcgacagagtgagactctgtctcaaaaaaaaaaaaggctctccaaagtgtcatgttcagcaccaaaagggaataggcacagggtgaccccagaagttcatttgtgacacttaaatctccagatatttatcccacgtgggtctgatgcgggctcagcactaaattaactgtatgtggaaagtgtcaattgcagagccttctgtatcgatgaggcttccgccacttgtccatgcttagcccccttgcctcttccttgggagcatgctttctattcctatgtgaaacagcctgacataagtgaaaggatttgggctcaagcaaacatgagatgtgggttcatatcttggcaccactcctgatagctgtgtgatcatggcaaacctcgttttcatcgtctgtcaggtggagatgaagagaaatggtgcatgtaaagtgctcagcatctgtgcttagcaggccatagtctccctgcctcctttttcttgagtaagcctttagaactttctgactcctctagagaaggcagagaaacgaatatattttgggtgccatttggagtctgggtcttttgttaaaattgtcctgtattatgttgaaaagtgtcggttacccccaggctctgggggcatctgtgatcatagaatactgccatgcttattttgcctttctatgttgagattaattcactgacgcctcattttccacgtgcatctgtcatagtctgggtaccagattgtatttagagaatggctcttgccactgttatgtacacacagatcgtgtgtgtaaacaagcaaattaaagtaaactgagataatgaaatcccaaaaaaaaaaaaaaaaaaaaaaaaaattggaggggaactctaatatgccggggtggcgcggaaacaagagggggtacaatgagaatggggcacctgtgggccataagccgtggtccctgagacccaggttttcgtgcgtgacacacggggggcaaaatctggcggggcccccatatagaggagagggcgaacaaaatttgcggaaaacgggcgcgtttcgaggacggccttctctggataaaaaagtggcgtggcaaaaaaacggggacacaaaaagagaggaacaaaaggaaaggagaaacgaaaggaggacagaggcgacaacagccgcgggggggacaatcaccaaccgacaagaggaagagaacgaacaaaagacggggagtggagcagagcaagacacgagagagaaaaaagaagaggagccgaaaaagagaaacaacgaattggcgacaagagcaaaagcgaagtcgcagacgaggagcacaagaagaaggaaagaacaagggggagggacacaaaaagaaacagaaaagaggagcggaggcgtggcggcagagagcgaccgggaagaaggatgggagacacaggaaaagaaagggggacgcggacagaaagaagcggaagggagggga

SEQ ID NO: 29878 - DNA, 3193 bp, Homo sapiens
  misc_feature (263)..(263): n is a, c, g, or t
  misc_feature (286)..(286): n is a, c, g, or t
aatgcctagcttttaaaaatttaattaattgcctatttttgagacagagtctctctctgtcatctaggcttgagtgcacttgcgccatctcagctcactgccacctctacctccccgggtccagccatcctcctgcctcagccttcccagtattctggggcacaaggtgtgcgtccccccgcccggcttaattttttgcctttttttttttgagacggagtcttgctctgttgcccaggctggagtgcagtggtgcgatctcngctcactgcaacctccacctccngggttcaagcgattctcctgcctcagcctcccgagtagctgggattacaggcatgcgtcaccacaccaggctaattttgtatttttagtagagatggggtttctccatgttggtcaggctggtctcaaactcctgaccgcaggtgatccacctgcctcggcctcccaaagtgctgggattacaggcatgagccaccgcgcccggctcaggcagggttctttataaaaacagcctgatgcctgaaggacactctctggttgtaatatttgtttcatccatgaagtgtttaaatattgcaactgacttgcgattagccaccaaaacaggcccttttagatgcagtgcctctccgaccaagtattggatgattcatacgtaatggactatgatcattttctgtccatgttttctattactatatgctggtttttttggagcaataagattactttttttctgttctattttgagcgaatcctttacagtttttgataagaactgtgacatttgttctttgttgataaaactcctgaaaataactcacaaggccagtgctgcactctggcacatgtaggttgttttgagggtttgttggttggttggttggctggttgattggttggttggtttagaacactaatgtacttgttatgaaccaaactctggtcttacagtcttaaattccacctcatggggctgttttctctgttagcaatgaaacctgggccaggtgtagtggctcacacctataatcctggcactttgggaggctgaggtgggaggattactggatcccaggagtttgagaccagcctgggcaacatagtgagaccctggtttctataaataaataagataatcaaaccagaaagcaggcattttagtaacagcctgttgaattttaaggtgaatcaaggtaattttgcagaatgcgttcttgcaccgaaatgtccctgaccacatatcagtggtatagactgaacagtgtgcttcagggtcatgtgctgagtgcactgatcactctgctgtggcccagggcatctgtacctgttggacaagattatgataattcagaagtgaagtaaaatgcctccctctgatggcaaaaagccaacctgtttgcaaaatcacccttattgaagggtggcatggctgtggtccctccctcctgttacttgcatcaccaaccaaactaaaccaaaccatacctgggcctgttcagctggacttgaaatcagtttcctttttctctcccctttgcagcacttttcagtttccagctttgtcattctgtggcctttgctgtgacaatgctgggaagggttagaaatcctgtcacctccatccacaaaggcacagttccacgccctgtgataagatatcccctcttctctcccagactgtctccttaagcctttcaaactgagccccttgctgttggggtaatcacccttaaggccgccttgatgcccctctctccaatcaagtccaatagtagcattaactgagaagcactacacctgactggcttcactgaagcttaagtggttgaggatgaatcttcggtgtaaaatcttttactataaggatatattttaaatatttcatatcccatcaagttggaggttaattttatccatcacaatgagtcatgatttgttgcacccaaaaggagcagaaacacaggtgatgagatatgggaggtggcaccatggtgctttggaggcgttggtaagatgtgaccctctgttgcctatgcccataaaccagtggtgggagtggccatggagtagatggcaggggcttgttgaagggattgaaagctctcctaggctaggcatggtggctcacacctgtaatcctagcactttgggaggctgagatgggaggatcacttgaggttgggccagcctagccaacatgataaaaccccgtctcgactaaaaatacaaaaattagccaggtgtggtggtacacgcctgtaatcccagctactcgggaggctggggcaggagaatcgcttgaacccaggaggcagaggttgcagtgagctaggatcacgccactgcactccagcctgagcgacagagtgagactctgtctcaaaaaaaaaaaaggctctccaaagtgtcatgttcagcaccaaaagggaataggcacagggtgaccccagaagttcatttgtgacacttaaatctccagatatttatcccacgtgggtctgatgcgggctcagcactaaattaactgtatgtggaaagtgtcaattgcagagccttctgtatcgatgaggcttccgccacttgtccatgcttagcccccttgcctcttccttgggagcatgctttctattcctatgtgaaacagcctgacataagtgaaaggatttgggctcaagcaaacatgagatgtgggttcatatcttggcaccactcctgatagctgtgtgatcatggcaaacctcgttttcatcgtctgtcaggtggagatgaagagaaatggtgcatgtaaagtgctcagcatctgtgcttagcaggccatagtctccctgcctcctttttcttgagtaagcctttagaactttctgactcctctagagaaggcagagaaacgaatatattttgggtgccatttggagtctgggtcttttgttaaaattgtcctgtattatgttgaaaagtgtcggttacccccaggctctgggggcatctgtgatcatagaatactgccatgcttattttgcctttctatgttgagattaattcactgacgcctcattttccacgtgcatctgtcatagtctgggtaccagattgtatttagagaatggctcttgccactgttatgtacacacagatcgtgtgtgtaaacaagcaaattaaagtaaactgagataatgaaatccca

SEQ ID NO: 29879 - DNA, 3767 bp, Homo sapiens
attattgatcctacttcagagggaaagtgtaccaggcagttttggtgggtggtgctgaagtctggggagtgagtttagtcttcagactattcttggcgacatcaccagtgttgcaagcaccaccattcccagttaggcactttttgtccctggtaagacttgacctttatctggaacactccttttgtccctagagtggggacctaaggctcagcaaaagggcagaatcaggaaagcctttatggtgtggctaaaggagtggccagagccttgggactcctttgctgccttctccctggttccagttgtctttagattttcacggctcttactgctgttacttaacagtattttccagccaggcatggtggttcacacctctaatccctcccaaagtgctgggattacaggcatgagccaccgcgcccggctcaggcagggttctttataaaaacagcctgatgcctgaaggacactctctggttgtaatatttgtttcatccatgaagtgtttaaatattgcaactgacttgcgattagccaccaaaacaggcccttttagatgcagtgcctctccgaccaagtattggatgattcatacgtaatggactatgatcattttctgtccatgttttctattactatatgctggtttttttggagcaataagattactttttttctgttctattttgagcgaatcctttacagtttttgataagaactgtgacatttgttctttgttgataaaactcctgaaaataactcacaaggccagtgctgcactctggcacatgtaggttgttttgagggtttgttggttggttggttggctggttgattggttggttggtttagaacactaatgtacttgttatgaaccaaactctggtcttacagtcttaaattccacctcatggggctgttttctctgttagcaatgaaacctgggccaggtgtagtggctcacacctataatcctggcactttgggaggctgaggtgggaggattactggatcccaggagtttgagaccagcctgggcaacatagtgagaccctggtttctataaataaataagataatcaaaccagaaagcaggcattttagtaacagcctgttgaattttaaggtgaatcaaggtaattttgcagaatgcgttcttgcaccgaaatgtccctgaccacatatcagtggtatagactgaacagtgtgcttcagggtcatgtgctgagtgcactgatcactctgctgtggcccagggcatctgtacctgttggacaagattatgataattcagaagtgaagtaaaatgcctccctctgatggcaaaaagccaacctgtttgcaaaatcacccttattgaagggtggcatggctgtggtccctccctcctgttacttgcatcaccaaccaaactaaaccaaaccatacctgggcctgttcagctggacttgaaatcagtttcctttttctctcccctttgcagcacttttcagtttccagctttgtcattctgtggcctttgctgtgacaatgctgggaagggttagaaatcctgtcacctccatccacaaaggcacagttccacgccctgtgataagatatcccctcttctctcccagactgtctccttaagcctttcaaactgagccccttgctgttggggtaatcacccttaaggccgccttgatgcccctctctccaatcaagtccaatagtagcattaactgagaagcactacacctgactggcttcactgaagcttaagtggttgaggatgaatcttcggtgtaaaatcttttactataaggatatattttaaatatttcatatcccatcaagttggaggttaattttatccatcacaatgagtcatgatttgttgcacccaaaaggagcagaaacacaggtgatgagatatgggaggtggcaccatggtgctttggaggcgttggtaagatgtgaccctctgttgcctatgcccataaaccagtggtgggagtggccatggagtagatggcaggggcttgttgaagggattgaaagctctcctaggctaggcatggtggctcacacctgtaatcctagcactttgggaggctgagatgggaggatcacttgaggttgggccagcctagccaacatgataaaaccccgtctcgactaaaaatacaaaaattagccaggtgtggtggtacacgcctgtaatcccagctactcgggaggctggggcaggagaatcgcttgaacccaggaggcagaggttgcagtgagctaggatcacgccactgcactccagcctgagcgacagagtgagactctgtctcaaaaaaaaaaaaggctctccaaagtgtcatgttcagcaccaaaagggaataggcacagggtgaccccagaagttcatttgtgacacttaaatctccagatatttatcccacgtgggtctgatgcgggctcagcactaaattaactgtatgtggaaagtgtcaattgcagagccttctgtatcgatgaggcttccgccacttgtccatgcttagcccccttgcctcttccttgggagcatgctttctattcctatgtgaaacagcctgacataagtgaaaggatttgggctcaagcaaacatgagatgtgggttcatatcttggcaccactcctgatagctgtgtgatcatggcaaacctcgttttcatcgtctgtcaggtggagatgaagagaaatggtgcatgtaaagtgctcagcatctgtgcttagcaggccatagtctccctgcctcctttttcttgagtaagcctttagaactttctgactcctctagagaaggcagagaaacgaatatattttgggtgccatttggagtctgggtcttttgttaaaattgtcctgtattatgttgaaaagtgtcggttacccccaggctctgggggcatctgtgatcatagaatactgccatgcttattttgcctttctatgttgagattaattcactgacgcctcattttccacgtgcatctgtcatagtctgggtaccagattgtatttagagaatggctcttgccactgttatgtacacacagatcgtgtgtgtaaacaagcaaattaaagtaaactgagataatgaaatcccaaaaaaaaaaaaaaaaaaaaaaaaaattggaggggaactctaatatgccggggtggcgcggaaacaagagggggtacaatgagaatggggcacctgtgggccataagccgtggtccctgagacccaggttttcgtgcgtgacacacggggggcaaaatctggcggggcccccatatagaggagagggcgaacaaaatttgcggaaaacgggcgcgtttcgaggacggccttctctggataaaaaagtggcgtggcaaaaaaacggggacacaaaaagagaggaacaaaaggaaaggagaaacgaaaggaggacagaggcgacaacagccgcgggggggacaatcaccaaccgacaagaggaagagaacgaacaaaagacggggagtggagcagagcaagacacgagagagaaaaaagaagaggagccgaaaaagagaaacaacgaattggcgacaagagcaaaagcgaagtcgcagacgaggagcacaagaagaaggaaagaacaagggggagggacacaaaaagaaacagaaaagaggagcggaggcgtggcggcagagagcgaccgggaagaaggatgggagacacaggaaaagaaagggggacgcggacagaaagaagcggaagggagggga

SEQ ID NO: 29880 - DNA, 635 bp, Homo sapiens
attattgatcctacttcagagggaaagtgtaccaggcagttttggtgggtggtgctgaagtctggggagtgagtttagtcttcagactattcttggcgacatcaccagtgttgcaagcaccaccattcccagttaggcactttttgtccctggtaagacttgacctttatctggaacactccttttgtccctagagtggggacctaaggctcagcaaaagggcagaatcaggaaagcctttatggtgtggctaaaggagtggccagagccttgggactcctttgctgccttctccctggttccagttgtctttagattttcacggctcttactgctgttacttaacagtattttccagccaggcatggtggttcacacctctaatccctgcactttgggaggccgaggcaggcggatcacctgggattgggagttcgggaccagcctgtccaacatggcgaacctcgtctcttctgagagtacaaaaattagctgggtgtggtggcacatgcctgtggtcccagctgctcgggaggctgaggcgggagagttgcttggacctgggaggtggaggttgcggtgagctgaggtcgcaccactgcactccagcctgggtgacagagcagactccatct

SEQ ID NO: 29881 - DNA, 115 bp, Homo sapiens
ttcaggtaaaggccaagagacagacaagtagggtcacgaattgcccaaggcctacagccagtggtgtactagtaaatgtttcacagtccaccctccaaaaaaaaccaaaaataaa

SEQ ID NO: 29882 - DNA, 422 bp, Homo sapiens
tttttttttaaggtatgatcttactctgtcacccaaggtaagagtgcagtggcacaatcatgattcactgcagcctcaacctcctgggcttaagcaatccttccacctcagcttcccaagtagctgggaccacaggcatgcaccaccatgcccagctaattcaaaaaaatctttttgtgcagatgtggtctccctatgttgctcaagctggtcttgaactcttgggctcaagtgatcctcctaccttggcctcccaaagccaagaggcatgagccactgggcctggcccaacttttctagtgaatggtttttcacagtggatataccaattgatacccccatcagcaatatgtgagtgatcctaatgactaaaaccctctccaaaacttgactttattgtgtttcttcattttcaccaatcg

SEQ ID NO: 29883 - DNA, 290 bp, Homo sapiens
ctgggccgcctgtaatcccaacattttgggaggcctaggtgggcagatcgagaggtcaggagtttgagatcagcctggccaacatagtgaaatcccgtctctactaaaaacacattaaaaaaaaaaaaaaaaaacacctagctgggcgtggtggtggacacctgtaatcccagctacttgggaggctgagggaggagaatcacttgaacccaggaagtagagggtgcagtaagacgagattgtgccactgcactcgaaccctggcaacagtgccagactccctctcaaaa

SEQ ID NO: 29884 - DNA, 426 bp, Homo sapiens
gacaggagtgtcagtttcctgaatcagattccccggacttagcagacaacagtgcaggagctgtgagttgggtctcggctctgctgttaacctgtatcttgtatttgtcacttctggacctcatatcttttggaagtcagaacctaacaggaagtggtatttaggaaagtcagaatatcagctccaaacctgagcattccatcaaagaaacacagaaggggctggaatatggtgtccaatacctggggaaggttgaggagtaacagccctggggcagttattgggcagtattcctgtatatctcagggttaccttgggctcatgtggctgtaaaatgtgtggttcttggagcaggtgtactgagaagatgaggatgatatgagctctgagaggggctaaggcagctcctgccaggaatcttctatg

SEQ ID NO: 29885 - DNA, 1056 bp, Homo sapiens
gcggccgccgccgacctcagcatcccagaagccgggcgcacgtgggtcggggcggggacgcggcgctcaggctgcagccgcggcagcctgcggggggcgggaatggggcgccgcggcgggggctcggctgatgacatcacggccaggctgcggcagcgcgggcgcgcggacatggctgcggcggtttcggcggcgtccgcgggctgcacccgggcctgagagcccagcgccctcccgcggggccgcccgccagtccgcgccgtccgcgggtgcattggccgggtgcctctagcttcccggacacccggagcttccgcctatccagcctccctcggccaaattgctgcggagcccgtcgtcagggggcgccaaggagccagggggaaaaccaagaggcgctgacaggagcctcccggcggtgctaccctccacctcccacctccctgcgccccgccccgaggttggggctttgaagaatgcagccggggaaagcattaacttttgagctacgtccagaatagcatcatcttcatgggtattccctactcctaggatttcagaaaacctttgataactaattgagaaaatgcagaagatcgtgcagacagatgaaattaccaatacacaagcttttagaaaaggaaagaggaaaagaacagagacaatggactcagaaaatgcaaatagtgacatggataaaggacagagagacccatattcgggaaatgcctttctgcctggtgaaagctccagtgaggatgaagagcctttagcagaattgtcaaaggaagaattgtgcgccaaaataaaaagcctgaaagaaaaactaacaaacacccggaaagaaaacagccgacttcgacagtctttggtcatgcttcaagcttggtccagagagctgccttagactctccaatgaatgtgttcaaacagctgcctctgttaccttgactcatctcagatacgggtcctggtgctaggaatcaaagactgtctctattattttggcttgctccaggttgggcagaagcccatgcaaggctactactgatcatg

SEQ ID NO: 29886 - DNA, 2137 bp, Homo sapiens
gcggccgccgccgacctcagcatcccagaagccgggcgcacgtgggtcggggcggggacgcggcgctcaggctgcagccgcggcagcctgcggggggcgggaatggggcgccgcggcgggggctcggctgatgacatcacggccaggctgcggcagcgcgggcgcgcggacatggctgcggcggtttcggcggcgtccgcgggctgcacccgggcctgagagcccagcgccctcccgcggggccgcccgccagtccgcgccgtccgcgggtgcattggccgggtgcctctagcttcccggacacccggagcttccgcctatccagcctccctcggccaaattgctgcggagcccgtcgtcagggggcgccaaggagccagggggaaaaccaagaggcgctgacaggagcctcccggcggtgctaccctccacctcccacctccctgcgccccgccccgaggttggggctttgaagaatgcagccggggaaagcattaacttttgagctacgtccagaatagcatcatcttcatgggtattccctactcctaggatttcagaaaacctttgataactaattgagaaaatgcagaagatcgtgcagacagatgaaattaccaatacacaagcttttagaaaaggaaagaggaaaagaacagagacaatggactcagaaaatgcaaatagtgacatggataaaggacagagagacccatattcgggaaatgcctttctgcctggtgaaagctccagtgaggatgaagagcctttagcagaattgtcaaaggaagaattgtgcgccaaaataaaaagcctgaaagaaaaactaacaaacacccggaaagaaaacagccgacttcgacagtctttggtcatgcttcaagtgttaccacaagcagtcacccagtttgaagaattggttggtatggccgaggctctgcttaagggtgggggaaccatgtctacatctgcatccaccctctggagagcaacaaacaactcctcgccagattcatttgcctcaacatgcagtaattctaattctaactccagttcaccagtttccttaaagcctgaggaagagcatcagactgatgagaaacagttccagattgaaaaatggcagattgcccgttgtaacaagagcaagcctcagaagtttattaatgatttaatgcaagtactttacacaaatgaatacatggccactcacagcctgacaggggcaaaatcctctacttcaagggacaaagctgtaaaaccagctatgaatcagaatgaagtccaagaaatcataggagtaacaaaacaattatttcccaatacggatgatgtttcaattaggagaatgatagggcaaaagctaaacaactgtaccaagaagccaaatttaagcaaaaatcttaactctcaggatattaaatagatccttttggtattacaggtatctgaaacaaagcaccttcaattctaaatctagcactggattttgttggagaatctgcagccttcctggcagtgagaaagacagacatgtgcagtgacaggctgtaagacatatgtaacattgctgagctctcctaagggaccaacaagcttgctgaagaagctgcatgtagattccaccctcagtactagtgatgcatcaaaccagagaatttctgccagtcaaataagcatgcaatatggtttctttggaaataagcatttcccaatccccaaatacccctctgtacagttaatctaacaggatagtcagagctcttatcatagcagccaaaacttcagcccataggttagtcattgtcctaaccaatcattgtacattgattattaccagtgacttcccattatagtttttggatctttagcataagcacatgcttgcaaaagtaaacagtgaaataattaatgttggcaaatatgagaacaacaaagtcagcccaaaatctgataatcatgtctaaccaagtaataatgttttagcaataaaattacaggattattctgttatctaaaaatgtataaaatgggaatatgaaaaaaatgacaacagcaagatgttttattttaatgttaagcaattccaccacacttctgaagaataaacctaagtttttgtgattgttaaaacaat

SEQ ID NO: 29887 - DNA, 1532 bp, Homo sapiens
ctccaaaacgacatggatcacatctggttttgctcccagttttatccctcacacctagcgtagtggttggcaaatactgagaatctgtgtaacatggacttgggaggcagccagtctgaatttgaatcttggctcttctcttcactaactatgtttgactctggacaaattactttacttcttcttgcctaattgacttcatctggaaatggcaggaaacaaactagatataacaacagagaagaccattttacatggaggcatgaaaactttgaatgttgttaccacaagcagtcacccagtttgaagaattggttggtatggccgaggctctgcttaagggtgggggaaccatgtctacatctgcatccaccctctggagagcaacaaacaactcctcgccagattcatttgcctcaacatgcagtaattctaattctaactccagttcaccagtttccttaaagcctgaggaagagcatcagactgatgagaaacagttccagattgaaaaatggcagattgcccgttgtaacaagagcaagcctcagaagtttattaatgatttaatgcaagtactttacacaaatgaatacatggccactcacagcctgacaggggcaaaatcctctacttcaagggacaaagctgtaaaaccagctatgaatcagaatgaagtccaagaaatcataggagtaacaaaacaattatttcccaatacggatgatgtttcaattaggagaatgatagggcaaaagctaaacaactgtaccaagaagccaaatttaagcaaaaatcttaactctcaggatattaaatagatccttttggtattacaggtatctgaaacaaagcaccttcaattctaaatctagcactggattttgttggagaatctgcagccttcctggcagtgagaaagacagacatgtgcagtgacaggctgtaagacatatgtaacattgctgagctctcctaagggaccaacaagcttgctgaagaagctgcatgtagattccaccctcagtactagtgatgcatcaaaccagagaatttctgccagtcaaataagcatgcaatatggtttctttggaaataagcatttcccaatccccaaatacccctctgtacagttaatctaacaggatagtcagagctcttatcatagcagccaaaacttcagcccataggttagtcattgtcctaaccaatcattgtacattgattattaccagtgacttcccattatagtttttggatctttagcataagcacatgcttgcaaaagtaaacagtgaaataattaatgttggcaaatatgagaacaacaaagtcagcccaaaatctgataatcatgtctaaccaagtaataatgttttagcaataaaattacaggattattctgttatctaaaaatgtataaaatgggaatatgaaaaaaatgacaacagcaagatgttttattttaatgttaagcaattccaccacacttctgaagaataaacctaagtttttgtgattgttaaaacaat

SEQ ID NO: 29888 - DNA, 2201 bp, Homo sapiens
gcggccgccgccgacctcagcatcccagaagccgggcgcacgtgggtcggggcggggacgcggcgctcaggctgcagccgcggcagcctgcggggggcgggaatggggcgccgcggcgggggctcggctgatgacatcacggccaggctgcggcagcgcgggcgcgcggacatggctgcggcggtttcggcggcgtccgcgggctgcacccgggcctgagagcccagcgccctcccgcggggccgcccgccagtccgcgccgtccgcgggtgcattggccgggtgcctctagcttcccggacacccggagcttccgcctatccagcctccctcggccaaattgctgcggagcccgtcgtcagggggcgccaaggagccagggggaaaaccaagaggcgctgacaggagcctcccggcggtgctaccctccacctcccacctccctgcgccccgccccgaggttggggctttgaagaatgcagccggggaaagcattaacttttgagctacgtccagaatagcatcatcttcatgggtattccctactcctaggatttcagaaaacctttgataactaattgagaaaatgcagaagatcgtgcagacagatgaaattaccaatacacaagcttttagaaaaggaaagaggaaaagaacagagacaatggactcagaaaatgcaaatagtgacatggataaaggacagagagacccatattcgggaaatgcctttctgcctggtgaaagctccagtgaggatgaagagcctttagcagaattgtcaaaggaagaattgtgcgccaaaataaaaagcctgaaagaaaaactaacaaacacccggaaagaaaacagccgacttcgacagtctttggtcatgcttcaaggaaacaaactagatataacaacagagaagaccattttacatggaggcatgaaaactttgaatgttgttaccacaagcagtcacccagtttgaagaattggttggtatggccgaggctctgcttaagggtgggggaaccatgtctacatctgcatccaccctctggagagcaacaaacaactcctcgccagattcatttgcctcaacatgcagtaattctaattctaactccagttcaccagtttccttaaagcctgaggaagagcatcagactgatgagaaacagttccagattgaaaaatggcagattgcccgttgtaacaagagcaagcctcagaagtttattaatgatttaatgcaagtactttacacaaatgaatacatggccactcacagcctgacaggggcaaaatcctctacttcaagggacaaagctgtaaaaccagctatgaatcagaatgaagtccaagaaatcataggagtaacaaaacaattatttcccaatacggatgatgtttcaattaggagaatgatagggcaaaagctaaacaactgtaccaagaagccaaatttaagcaaaaatcttaactctcaggatattaaatagatccttttggtattacaggtatctgaaacaaagcaccttcaattctaaatctagcactggattttgttggagaatctgcagccttcctggcagtgagaaagacagacatgtgcagtgacaggctgtaagacatatgtaacattgctgagctctcctaagggaccaacaagcttgctgaagaagctgcatgtagattccaccctcagtactagtgatgcatcaaaccagagaatttctgccagtcaaataagcatgcaatatggtttctttggaaataagcatttcccaatccccaaatacccctctgtacagttaatctaacaggatagtcagagctcttatcatagcagccaaaacttcagcccataggttagtcattgtcctaaccaatcattgtacattgattattaccagtgacttcccattatagtttttggatctttagcataagcacatgcttgcaaaagtaaacagtgaaataattaatgttggcaaatatgagaacaacaaagtcagcccaaaatctgataatcatgtctaaccaagtaataatgttttagcaataaaattacaggattattctgttatctaaaaatgtataaaatgggaatatgaaaaaaatgacaacagcaagatgttttattttaatgttaagcaattccaccacacttctgaagaataaacctaagtttttgtgattgttaaaacaat

SEQ ID NO: 29889 - DNA, 1203 bp, Homo sapiens
gcggccgccgccgacctcagcatcccagaagccgggcgcacgtgggtcggggcggggacgcggcgctcaggctgcagccgcggcagcctgcggggggcgggaatggggcgccgcggcgggggctcggctgatgacatcacggccaggctgcggcagcgcgggcgcgcggacatggctgcggcggtttcggcggcgtccgcgggctgcacccgggcctgagagcccagcgccctcccgcggggccgcccgccagtccgcgccgtccgcgggtgcattggccgggtgcctctagcttcccggacacccggagcttccgcctatccagcctccctcggccaaattgctgcggagcccgtcgtcagggggcgccaaggagccagggggaaaaccaagaggcgctgacaggagcctcccggcggtgctaccctccacctcccacctccctgcgccccgccccgaggttggggctttgaagaatgcagccggggaaagcattaacttttgagctacgtccagaatagcatcatcttcatgggtattccctactcctaggatttcagaaaacctttgataactaattgagaaaatgcagaagatcgtgcagacagatgaaattaccaatacacaagcttttagaaaaggaaagaggaaaagaacagagacaatggactcagaaaatgcaaatagtgacatggataaaggacagagagacccatattcgggaaatgcctttctgcctggtgaaagctccagtgaggatgaagagcctttagcagaattgtcaaaggaagaattgtgcgccaaaataaaaagcctgaaagaaaaactaacaaacacccggaaagaaaacagccgacttcgacagtctttggtcatgcttcaagtgttaccacaagcagtcacccagtttgaagaattggttggtatggccgaggctctgcttaagggtgggggaaccatgtctacatctgcatccaccctctggagagcaacaaacaactcctcgccagattcatttgcctcaacatgcagtaattctaattctaactccagttcaccagtttccttaaagcctgaggaagagcatcagactgatgagaaacagttcagatgaaaaatgcgattgcgtgtacagagcagctaagttttatgttatgcagcttccaagatctgcctcagcgaagcaatcttctaggcagtgaa

SEQ ID NO: 29890 - DNA, 536 bp, Homo sapiens
ggggccgctcccacttcaggcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaag

SEQ ID NO: 29891 - DNA, 3050 bp, Homo sapiens
agcggggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29892 - DNA, 2536 bp, Homo sapiens
agcggggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29893 - DNA, 2895 bp, Homo sapiens
caggaaacaggtatgactcgttacttggaaaaacctgcggtgggatttaccggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29894 - DNA, 2443 bp, Homo sapiens
agcggggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgaaaggtgtagcagtcactcggcctacacccacagcatcgaccttgtgaacccagcgacctgactgccttggtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29895 - DNA, 1824 bp, Homo sapiens
aggctaggtagaggcggggggaatttggagagggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29896 - DNA, 1841 bp, Homo sapiens
agtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29897 - DNA, 1808 bp, Homo sapiens
gcatgctccgagcgcggcgcccccgacgcggcgctcggctcggctcgggcatttccgcctctttgttttaaactccggacgggcttttttctcctcctcttgtggtggggacccagagggagcggcgccccctcccccctccggcgcggaccccgcgtgcgccttgctcgcccgcagccccgagaccgcaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29898 - DNA, 1688 bp, Homo sapiens
agcggacaggcacgacgatcgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgtgaaaggtgtagcagtcactcggcctacacccacagcatcgaccttgtgaacccagcgacctgactgccttggtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29899 - DNA, 4014 bp, Homo sapiens
agcggggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaacaaaaaaaaagaaaaaaaaaaaaaaataagaaataaatatcacatagaaaaaaacatgacacagatataaactatgatacatcactgcgcaagatataggagagctcacagaattcttatacttatagatgtgccatggcttcgtgcatttccttcattcctgtaatgtagacccatgtatatgaacattagatacattacactagtgagcacataaatcgag

SEQ ID NO: 29900 - DNA, 3710 bp, Homo sapiens
agcggggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29901 - DNA, 4252 bp, Homo sapiens
agcggggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaaaaaaaacaaaaaaaaaaacacaaaaacaacacaaacacacaaaacaacaaaacaaaacatacaaacaacaaaaacccgggggcctctcattgcgagggggggcgacaacaaggtgttcacaaaggcgcgcacatgtgcacacagtctgttacccgcgcccacaactttctggccacaggcggacaaaacgtgggggaccccaaaaggggggccataaactccaacaacaccgcgggttcaccgtttattatatcgtgcgcgagaatcggccgataccaccgccacacgcccgtcgcgccgcccacacccagcgccgccacgctcccacagcgcctacacacgctacccgcgccagcaccaacgacgtcactctgcgcggtgccctccctggtcggcgaaaacacatcggagcgagtctggagtcagtactcacatctgtgagtataggcacaatcatgtctccacagccgcaggaacgagaagcaactacatcatcctcatccaacacatctaatcaaatatctatctcaccatcctctagacatatatcaacttataccatatcagaatacaactcaacaccacacaaagacagccatatgaacatacaactaaaatcaacacagaagagtaaacatagattactgcagaaaatcttacagctaattataataaataaactcataaccacactgaatcaataaacaatctcctaaacataccagacatctcaacaccacctatttctactttagtatcttactc

SEQ ID NO: 29902 - DNA, 2935 bp, Homo sapiens
agcggggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacacagcagaacagctatgggaatcgatgacgagatcgacagccgacacaactctacctgttgcattggtagaactg

SEQ ID NO: 29903 - DNA, 2569 bp, Homo sapiens
agcggggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccttttccacagtctgcatgacccttgttgaactagttcctggcagacctttcaacctgccat

SEQ ID NO: 29904 - DNA, 2592 bp, Homo sapiens
agcggggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaag

SEQ ID NO: 29905 - DNA, 700 bp, Homo sapiens
agcggacaggcacgacgatcgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgccttccagacagagggagcagttggaaaaaagtcggaggctgagtcgttccaacatggcgcagatgccacaaggacactagcacaccagcaggaagctgaacagaaggctggaggtgccacggtgacaaggacgggatcctgtcaggccaggtaagcttctgctctgccagtgacacggaaagggacaatgaagggccacagatacagaaagcatgtctgtgcagcctgcagagttcaggtgaaggagggacccaggcaggagcagtcagaaccaggagggcttaggcaagagacaggacaggcaaaggcactgatgcagcccacccagacttgacagacgcgttcatccaggtgttcatgtccttgtcactgtggacatctgtgttgcagccacagaaccacatactcgattaggacgcctgaacccaatcaatagtcgtttttccctacagaccctgggggaggcccacatgcacttgccctagggtactctgacattttggcactgcagtcccactgggaggccacatggag

SEQ ID NO: 29906 - DNA, 506 bp, Homo sapiens
agcggggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacactggcgaggctaggacactggcgaggctaggacactggcgaggctagga

SEQ ID NO: 29907 - DNA, 244 bp, Homo sapiens
aggctaggtagaggcggggggaatttggagagggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtg

SEQ ID NO: 29908 - DNA, 342 bp, Homo sapiens
gtaaggattcgcagcattgcacccgatccccgggcagctgtggacatgcgggtcagcccctaggactctgctgtctgaactcttccctcaggattactttctcgcttaggtatcaggggaggctgaacacccagagaggcaatgccaccaggggtgtgttcatctgcagtcagggagacctgggagggaattctgtccctgagtggttgtgtgatctgagggaagttacttgacctctccatgcaggaatttctgcctttgcaacgtgggaaaatatggattctgcagggttgacttgacattctcagtgagatgtttatcacgggccccacatccttcttg

SEQ ID NO: 29909 - DNA, 3791 bp, Homo sapiens
agcggggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29910 - DNA, 2342 bp, Homo sapiens
agcggacaggcacgacgatcgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgccttccagacagagggagcagttggaaaaaagtcggaggctgagtcgttccaacatggcgcagatgccacaaggacactagcacaccagcaggaagctgaacagaaggctggaggtgccacggtgacaaggacgggatcctgtcaggccagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29911 - DNA, 1733 bp, Homo sapiens
agcggggtcttaacccttcaattacgagcgggcggcgctgcgtttccagggcagaggaaacgaggcgccgcgttggcgcttggacggcgggaaccggctccggagcgagaacgcgcgtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29912 - DNA, 1933 bp, Homo sapiens
agcggacaggcacgacgatcgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgccttccagacagagggagcagttggaaaaaagtcggaggctgagtcgttccaacatggcgcagatgccacaaggacactagcacaccagcaggaagctgaacagaaggctggaggtgccacggtgacaaggacgggatcctgtcaggccaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29913 - DNA, 1781 bp, Homo sapiens
agcggacaggcacgacgatcgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29914 - DNA, 1582 bp, Homo sapiens
ctctcatatcactcaaccggattggctggagatcatgaaggcgcaatgagagttggaggtagatgtgggagtgtgcgttaggtgcacgcgtttcgtggtcatggcaacagaccggcccgtcgttaacagacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaa

SEQ ID NO: 29915 - DNA, 3829 bp, Homo sapiens
agcggggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcgggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagaggatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaacaacacaaacaaccaacgcacaacaacacaaaaacggc

SEQ ID NO: 29916 - DNA, 809 bp, Homo sapiens
ggcgtgagtgaattaatgcatgaaattcaggattgtactatagcatacttcctccagaacatagcaggaacctggaggcagaagggccagtgcactgactgcatcggcctctttccttctgcccctgaagtctacactgaatgacattgggtcgattttcctggtcagacttagtaagagacttgttaggggcaacagcagaggagggcttgatatttggctctttgctgatttggagacaaagaggcaaaggggaacagttcttattcaaaacatttaattatctagactctcctaaggacataaattcttcctgcaaatatctcttacatgcttttaaaaatattcagagtaacaggtttccacttataagttatgaagtttaagaatggttaagtactctctgtagtctgaaaaaaaatagcattgcgtctaaaggaagctaactttctctagaagaacaattttaacagtgggggaatctgtccccacacttgggccaatgtttatgacaaaccatcaagctcattaaaactcccagagaagaaagcaaagaggatggtacttggtccttgattaaggttttgccattgaatccttcaacctcctaccactgcttctagctgtcagttccagaatttgaaacgcggtggaagaggctagtgggtgtacagaaaaaccttccttgtgaagcagggcagtttcctcacactctgaccacaatcaaataccattaacttacaaaagacacaggctgcaaagctgaagagaaggagaattgtattccccgagacaacctgaaacaggca

SEQ ID NO: 29917 - DNA, 353 bp, Homo sapiens
aaaaaagaccctggtcccttaagcaaactgagcaatgggggttaggcacctccacatggaaacccctttagtttcactggccacagccagaaacctacagttgttttcctctttaggcactgcccagcaagggtcacaagttggaaaggaaaagagagagcaacagagagaaagagagagagattcccctgtatggagcaaaaaggaaaggatgaaggagaaaaatcccaagctttgggcctaccttctggaatttctcctgactggcttgccgaaatatgttattgatggagtgtgtccagtttcttggcatcttaaacacagaattggacaaactgcataaacaaagcagg

SEQ ID NO: 29918 - DNA, 441 bp, Homo sapiens
tttgcttccagttaacccttgctctgcccagtaccgaatttctgtcactgcctcctccaagaccttctcttgtattttgcccaaagcaggtgtcagaaccctttctgggggccgagcagcttggtgttgggaggctgtggttgagattcccggctctcttactcccttcccagggcttgggcaaattcttgcccccagtgcctcctctctgcttcctgactctcccttgagagcttggaccatagaccccagcacccttcctgctcaaggacacactccactctgagtatacacccaacagaaacacatacatatgttctctaaaagatgtgtattagaagccgggcacagtggctcacgcctgtaatcccaggaccttgggaggccaaggcaggtggatcacttgagcccaggagtttgagaccagcctgggcaacacag

SEQ ID NO: 29919 - DNA, 1173 bp, Homo sapiens
atcccagcaagttgggaggccgaggcgggcggatcgcttgaggtcgggagttcgagactagcctgtccaacatggtgaaacccggtctctactcaaatacaaaaattagccgggtgtggtggtgcacacctgtaattccagctactcaggaggctgaagcaggagaatcacttgagccgggaggcagaggttgcagtgagccgagatcgcgccactgcactcccgcctgggcgacagagcgagactgtctcaaaaataagaagttaaaatgggccaggcgcgcgcgcgcccctgtagccccaacgctttgaggctgaggcgggaggatctcgaacccaggacttcgcgccactgcactccaacctgaacgagtgagcggaccctgtctcataaaaaaagaaaaaagaaaacacacaagatgcgcctagttaacaccgccaattggtcactgctagtcgcgattccatatcgggagcttaacaaggtaatgaccttaatgatttgtggaatttctgagtattacccagtaaacttctggatgaaccagcagctacccagacaccctcagagcactggtcctatccctgccgtgttaaactgaatgtgcaccctaactcccatgtgaaatcctcaccccaaggcgttggtgcttcggaggtgactaggtcatgaggacagagccttcataaaagggaccccaagagctttgtgcagctttctactgtgtgaaggcagcgggaaggaagtctgcagtctggaagaaaccccttaccagaacctcagcgtgctgggcaccctgattttggaggttgtgacgtacccctgcttcccctttccactttcattcccagtgctgactgagaaacagagtcccttggccactctgtgacttcgccaactgtataatttcctctgcagacttgaacccgagccatagccatgaacgttcccaggcacagatgacagtaactaggttgttgctcaaaacacagaaagaaactggactcagcctgagccagattcctcaaaccctcatataaattccattcaccaaccccctcccccacggacatacctagagagaacttcatttctctcactgcctattgcaagaactgctgcagcccactctgtacaaaagccccacgaataaatgctctgggcgaatcaccc

SEQ ID NO: 29920 - DNA, 476 bp, Homo sapiens
ctaccctagctaatttacataaaaagactatctttatttttatagtaacaaaaaaagctaggattatctcatttaatccttataccatcattatgaagtgggtaatattatactcacaaaaggaagttaatcatttcttattttccacagacaccacaagctcaggaggctgcatcagcgtttcttattggaggcattttcttttcctccagattttgtttttgactgttaaggtagcttgttatagctacaaacaatcgatcaagcctaaaagggcatttataaaccacctacatctacatttttttcttactgttgatggatttaaaaagccgtttcaagatgaaatcttacaagtctttttcatgtcttctgagggctgagatataactttgaagtagagcccaaacatgaagatcatgaagacggcttcttctccaaatgatgttatcttaaaaacttgagaaaaaaaaaac

SEQ ID NO: 29921 - DNA, 900 bp, Homo sapiens
caggctggtaccgcccggagtatgagataaaaatgtaattgctccatttcctttattctttctttcattttcttccctctcactgtatattttagattgtcctgcttgactgccaggtcagacccagcacacaaagatatctgtcataagactggggagctgcagtgttctttttcataagaaatgaaatgcttgaaatttctcttccaaatgaatcacaaaacttccatggtcattttcattttaaattattttatgtctatgtaaactcatgcattgcctataacggaataatattcccagccatgtggatagtgacagagaatgagctgaaggcagcaatacttcacaggcaaagtggtacatgcatttttttttcatcttgcttttttccttttccatattcactcatccttttaaattctttgaatctactttttcctccctcgctcccttcctatcctccatctctatctttgtcatttattaattctttttcttctttttctccagacttggatatttctctatcctctcatcattctctttcatacacattctctgacttgtaggtcctaagattctcatattctaaaattaaccctctgcttaacagggtatgtttataaaccattggactgaggaggaattgcccaagttatcaaagacatcctatcaggaatgtcagccttttactctcattcatgctcagagaaacagtgctgcagggattatagcctggaatatggcagaaccagattttaaatttgtttgccctttgcctcctaatatccattttcccctaagtttaactgggcatatttcccagtttgccttgcaaatgtgttgccatatgactgcactttgtctaataaaatgaaactgagtatgttttgtgta

SEQ ID NO: 29922 - DNA, 517 bp, Homo sapiens
gttccttgggggttaaggttgccccaggttgccccactctcttaaactaattagcgtttacccttaggtctcacatgggagaggtggacatccaattaaattagtactctgccagcagggaaggaagaaatggatgctagtaggtaaccaacagtgtctgctgcatggagtaaggctgttttcagtttagaatctttgaaactaacatgaggtagcttctgtatgtttactattctcaggtgtatcatctttgtaacactggcaattggagatgttcctgatcacctgtggcacctataaccctttaccagctttccagcacttggtgacagtttgtctcaattgtccataaattgacacttggattagcctggtctgtcccaacaagattatcagctccttgacagcagggatatgccctctcttcatggtgtattcctcatgtcatgttagagatgcagtaggtatttagcagttatattggttcactgtgtattcattgagtgtttattatgta

SEQ ID NO: 29923 - DNA, 528 bp, Homo sapiens
aaaattcaccttttaagaccttaaagagccccacttaagacataaaggcaagggccaggtgtggtggctcacacctgaaatcccagtgctttgggaggccaggtgaaaggatcacatgaggccaagagtttgagatccagcctgggcaacagtgagactctgtctctccctctctctatacataaaaatacataaagagaattatttacttaagaactgctaccctgattgcttccagagagtccaacttaataaactacaggaattatctgtaatttattctacagatttagtcccctaatgaagaccaatgtgactttttgttgtggggaaggtgaagactgtcaagtattaatattctttttgaggggggttcttttaaggtggttaagatacatataatatacaatttgccattttaactatgttatatatacaattcagtgactattaattatattcacaatattgtgtaatcatcactaccatctatttccaaaactttttcataaccacaatcagaaactt

SEQ ID NO: 29924 - DNA, 413 bp, Homo sapiens
gctcagttgggcatcattttattcacctgagagggatggggaaagagtgagccctctttaacttctggatctacttccagatgctttagggagtttattaagaaaaagtgctggctgggtgcattggctcatgcctgtaatcccagcactttaggatgccaaggcgggcagatcacctgcggtcaggagcttgaggccagcttgaccaatgtggcaaaaccccacctctactaaaaatacaaaaattagccaggtgtggtggcggggggcgcctgtaatcccagctactggggaggctaaggcaggagaatcgcacaaacccaggaggtggaagttgtgctttggagctaaggtcatgccactgcactccagcctgggcaacatggtgagactctgtctcaaatttaaaaaaa

SEQ ID NO: 29925 - DNA, 638 bp, Homo sapiens
tggaagttctgacaaaataaaatgagaaaaacaaaaggtgtaaggattagaaagaattagaactaccactatttgcagatgattagattatcttcacagataacaaagattcatagtaaattatcagctttaattagaatctagtaagtagatcttctaagattactatacaaaaatcaagtgtatctctacataccaccaacacggaaaatgtcactaaaagatatattacttccaagagtaaaaaaacaatacaagacacttagaaataaacacaccaaagatatgcaagactcttataaagacaattagaaatgttactgaaaagcattaaggagatctaaacaatgaagagagagagagatgaagtttctggataggaagacatcatcatatagatataagttctccccaaactgatatattcaatttaatgcaaataaagatatcaacaagattcttttgtgaacttgtcaaaactaatttaaaaacctatgtaagaaagaaagaaaaattaaaacacctcggccgggtgtggtggctcacacctgtaatcccagcactgtgggaggcccaggcgggcggatcacgaggtcagcagattgagaccatcctggttaacatggtgaaatcccgtc

SEQ ID NO: 29926 - DNA, 460 bp, Homo sapiens
actctctcttccgcgtcgacataaatgaggggctactcccactttacagcagaatggcaggctactcagtatcgtgagatgcaccattccagaacctgagtcgatccagacaggttgtcaccgggtattcaacagagagcagcaacaattaccctcccgactagggtcccttgagacacaggtctggagaattctggcatgaagaaacagtgtttgtgacaatcaataatctttcaggttgacttaatgtggaaagaaaacagcattaaacaattatgctgcacatgaacatgctatataagagggtatagttgatcatttttatggtttcataaaaattcatttgcttttgggtgttacaaacacactaggaaactgaaacatctaacacaggcaaggcaccacctaaaaaataaaagcctgacaaattaagaaaataaaatatcaatttctaacccaa

SEQ ID NO: 29927 - DNA, 264 bp, Homo sapiens
agggacttgagcatccatggattttggtatccaatggagatcctataaccaatcccctatggataccaagggacaactgtatttactgaactgttaccagcaggctgcagatatagtcagatactaatggacacttaaaattgaaaacctgttaagaagtgcactgtacattttctttgtttgcttaaaagcagcttcctagaagctgtctagttctacctcgtgttaatcttttcacatcctacagagttttacagactttta

SEQ ID NO: 29928 - DNA, 349 bp, Homo sapiens
tttttttttgagaaaatttgaagtggattccaggactgatagatttatcgtgctttccagagatgacttgtagccatggttaagagccatagtaaataaaccaaagccataagaaagagggttcttcaaaaatttcaaacaatcagcagcactgaatgaccgtcacagccactaatgaagtttttttttttattattatgatactgaattgtaaaggttttcaacatgtcttaaaattgacactttcccatggggaagtagggtctgcattctctcccctggaacctggactaaacttagggaatgattgactggtagagcacagaggaggtgatactcggtgtcgacg

SEQ ID NO: 29929 - DNA, 320 bp, Homo sapiens
aaagttcttttagacttttgtgcatataaaaaatgaaatacaagcaaaatactatatatctgacatttttcagaatctaacttctcagagttacattttaactcaaactatctttatccttatttttccatcacagtattgtgtcttattccatctaaagtattgataaatcagcattacttaaaagaattctcagctgggtgtggggctcacacctgtaatctcaacactttgggaggccgaggtgggaggatcacttgagcccaggagttcaagaccaagcctgagcaatatagcaagaccttgtttttacaagaaac

SEQ ID NO: 29930 - DNA, 620 bp, Homo sapiens
aatttatcagcctaaattatgttgaacaacgcctaccttctgccccacaagcaaacttatgaaagcttcctggtgctgcctgaagacctatatctgtgagctcacaggtgtctaacctcagcttccttcctatcctgatgggctgaataaatttcttgaccttaccttttaaaataaatcatctttaaataattgtggggcttaggctgacctttctcaagaggttgacttatagctattacccttgtaactgaattctgcaagtttgcctgtcttacccaagattagcctatgaggatttccacaggtccagtgctagctttgagcagtgccttctttcaagctttaattttgctttctggcagctgggttttttaaattttatttatttatttatttatttatttttgagacgaagtctcactctgttgcccgggctggagtgcagtggcatgatctctgctcactgcagcctgcgcctcctgggttcaagtgattctactgcctcagccttccaagtagctgggatcacaggcatgtgccaccacgcccagctaatttttgtatttttagtagaaacggggtttcactgtgttggccaggctggtctcgaactccta

SEQ ID NO: 29931 - DNA, 479 bp, Homo sapiens
tgggccactgcactccagcccttcctggccttttccttgtgcatttgtactttttttttccagacagggtctcactctgtcacccaggctggagtggcttgacttcccaggctcaagcggttctcctgcctcagcctctggagttgcttgaactatacatggacgctgccatgctcagctatttttatcttcttattttttttatagagacggggtgtcactgtgttgctggtttcaaactcccggcctctcaaaagtggcctcaaagtgctgggatgactggtgcgagccactgcacccagccacatttgtacatttcaaacacaggttttgttttaagcaaaatggtcatgttgtacatattgttgcgcaacccgtttctttcacttaatttctgtggcatacagaaattctgcatatttctcacactatgggtgggtgggccaaaatttacttctttgctgctgtgaacatttctg

SEQ ID NO: 29932 - DNA, 416 bp, Homo sapiens
aggtggaaaggcccaggtgatgagccagccacatcacctcaaccacaggacccctgatggtggccctagagcctcctcttgaaatccaaagctcagtcccctcttcccagttcaggagcaaggaggtttctggcaggttaaaatggctaactcaggagcttgccacctttgaaaggcagcactgtgtagacagaggcagaaggatgggcttacgagacagtcctgggttcatatccttctctgacttaccagctctggaaccttaagcaagtgacgtaacctctctaagcctcagttgcctcatctttaaaatggcatccattagtggggcagcgcaccagcatggcacatgtatacatatgtaactaaccctgacaatgtgcacatgtaccctaaaacttagagtataataaaaa

SEQ ID NO: 29933 - DNA, 949 bp, Homo sapiens
aatagaggcacttttttaaaaagctaagacagcaacaagatccaatgataggagacttgatgatataaagatcttttctccctcttttctgtagacctgctagctgttgtagtctttctgttcattctctattcttaactatttcccttgagttcagtttgatgaaacctgtgtctgcctatgtcctcatacacaaattctggggtacaatgtaaacctattactgatttcaaccttagtttggagaaaaagtccacattttgtttgcccctccctttgcactaataattttcatggaaactgaaagcccactcttttttttgagatacagtctcactctgtcacccagggctggagtacagtgggcgcaatctcggctcactgcaacctacggccgcccacattcaggtgattctcctgcctcagcctccatagtgctggggattacaggtgtgagccaccactcccagccaaaagcacactctttttatactaacttaatcaatcttgagatcctcataagaaatatctagttacccatcttggtctctccataccctagtttctttgtatctacactctgtactgacttgagattctgttaagctcctctatctcatccctagaacctaagagacccaaagcaatcaaacaagcatacagttggccctcccatatcctcgagggattggttcccaggactccctgtggataccaaatccacagatgcgcaagtctcttatataaaatggcttagtacagtcagccctctgtatatgcaggtttgtatcagtagttttgtatcagccatgggttgaatgcttggatgtaaaacccaaagataaggaggactgactgactgtacttagcattacacacagtgaccaagcccatggtagcaattaaaaatcaacaccattgtttccaaacccctgtgtgaaagaaaaaa

SEQ ID NO: 29934 - DNA, 139 bp, Homo sapiens
ggcagaggagagatatgattaaagtgatgtatcagatagtcagaaggaggagaagaaactcatcatcaggaataatcatcctgagttctgtcatccaccacattgacattgatatgaccagggcaggattcctgaatct

SEQ ID NO: 29935 - DNA, 389 bp, Homo sapiens
tctcatactgaaagagagacctcacttcccatttcccaatccaaagtaaatgctgtgaaagaccaggaatgtagtaccgtcagcacacatctgggactgtttgtagcctacgttctgaaatcaggggatgctgacaggctcaagctgcgatactgaaaggaggcctggtttcccttctgttggaattacattacaaggagaaatattgatccagcatactcaagaatgggctgggtgtggtagctcatgcctgttatcccaacactttgggaggctgagacaggcagatctcttgagcccaagagttcaagacaagcctggacaacatggtgaaaccccgtctctacaaaaactacaaaaattagctgggcgtggtggcatgcgcctgt

SEQ ID NO: 29936 - DNA, 898 bp, Homo sapiens
tttcacttgaacacttagaggctataatagggtttttaattggcctaatttcaatattgttgtgtctcagaatagggaggcctgagtagaggaagacaggagaattactagtcagcatcgcagtcagaacacgtttctcaagtttgccatcttccatgtgtatggttcatagcatcccccaattacaatagtaacatcaaagatcactggtcacagatcaccgtaacagatataacaataatgaaaaaggttgaaatattccaggaattaccaaaatgtgacacagagacacaaagtaagcacatattgttggaaaaatggcattgatagacttgcccaaggcagggttaccataaaccttcaatttgtaaataacgcaacatctgtaaagtgcattaaagccaaggtatgcctgtaatgtgaaatagtgtcaagcgcataaatctgtgtgtgttactactaaattaggtaatccattttgggaggaaggtagaaaatcaagaagtaaagaaaggcaagatgccagaattttcggagcagcttcctagaagatagagcttgagcccttaaagggttcagctcctcaggaagggaaataaaggatttacacaagaagttgacttcatggaaacagcaaagatgtgttccaactccactaagagctgatgagtcaccctcattccacttcgggagactctttgattgctgaacgtctcacctctgtcttaggggttcccctggtgctgccggagttgcggttgacaatatcagagtcagtgtagggcaggggtttatgtgatgcttagatgctaacaatctaatgcaaaattaaggagttgaattaccagcagtaattgttagcagagcccttaccatctccatggtaaactaaaaaatt

SEQ ID NO: 29937 - DNA, 449 bp, Homo sapiens
cgtctttctgtgcctttatcaatgtgtgtgtgggcagttttgatttacacgtagaagaccatcaaagtgcaatgcagcttgctttttcacataatgtaaatacttctggtatctgcatataaacaccagcattgacatttttaatgattttgtagcattttgatgtatgaattgcaataatttcattacagtaatgttttccctaaaaatggacatatcaattgttttcaacttctccttttgcaaatataggatatccacaagtgaaattccaccaagtcaaaggttattcacatgtaaatttagctacatactgtaacttctcctccagaagtccgtaccagttttcattcctattaacaaaatgtgaatgcctgtctttcccacctgagctcagtgttccattttcaacaatctgatagataaaataaaagatattgtcagtttca

SEQ ID NO: 29938 - DNA, 556 bp, Homo sapiens
gcagaggaggctgggcttcgttctggaggtggggacacggtgaggtgaggtttagaaagcacacctgagccgcagtgtgtaggatgctggaaatggtggagatgggcctgcgaaagtgatgacccaggagcagcagccgggcacctaacaatgggtcagcaccgtgggcgtggagacgagagcggggattgatcaataccggagaagtacaatgtacaggacttgggttccatttggatggagtgggtgagggagagggaggagtcagaaatggcttccggtttccagcttgggcctggggattggagatgtccccactgagagtagggcacaagtgaggaaatggtttggagaggaagataagttacatcatggacatgctgagtctgagttgcctatgggacttggaatggggggtggcaaaatgtgtgtgatcttgagcaagatattcaacccttctgggccttggtcttcttatttgtaaaatggcgataagaatattacttcccatttgtgttgctgtgaatattaaatgcgctaccacatgtaaaaaaat

SEQ ID NO: 29939 - DNA, 401 bp, Homo sapiens
acccgggttatgctggtcgaaccgaattaccggaaaatctcaaagctcttttcagaccctgtgccatggtggcccctgacattgagctaatctgtgaaatcttgttagttgctgaaggttttgtggatgcgcgtgcattagcccgaaagttcattacgttgtacacgctttgcaaggagcttctctccaagcaggatcattacgactggggacttcgtgctattaagtctgtcttggttgtggctggatctctgaaacgaggagataaaaatagacccgaagatcaggtacttcatgagagcattaagggatttcaatatgcccaaaatagtgactgacgacatcccagtgtttctgggcctggtcggtgacctgtttccagccctggatgtgccccggag

SEQ ID NO: 29940 - DNA, 732 bp, Homo sapiens
aattcaaaaaagtgcaacctccagcataaataagttaatatctcctgatgattagaaacactcaataaactaaatatataagagaagattccataagatgacaagagaggcactaggaacacagaaaaatctactataaagacgtgtattaaaaatgcaagctggaggccaaggcggacagatcatttgagccccgcagttcgagaccagcctgggcaacataaggagatacccgtctccataataaaataaaaaattagacatggtggcacaaaacaaatggtattgaaacacctgaattagcaaatgcaaagaaatgaattagacacagaactgcaccttttacaaaactacttcctaatgaatcgtttacttatatggaaaatgcaaaactcacaatttcacacttgtcaaaaccaagacgaccttgatttggcaataagatttcacacacaacacaaaaagcatgatctgtgaatgagaaaatcaataaattggacttcattcaaaacaaaaatgttttggaaaagactgttaacagaataaaaagacaggcggcagactgggacaaaatatttgcagaacagctatctgatcaagaactggtacccaaaaggtatgaagaactcctaaaattctataagaaaaaaaccaaccaatcaaaaaataagcaaaacgctgggtgcggtggctcatgccttaatcccagcactttgggaggcagagacgggt

SEQ ID NO: 29941 - DNA, 693 bp, Homo sapiens
aatctgatgctaagttactaatcagaaacattgaagacaaggaacggctttgtcaaagatgcagtacaaaagtcagcatgtccgacatatgaatgtcagaaaacagccaggagggcaaaagaacactgggccagcagctagaacttcatcccaccatttactggttggggcaagtgactttctgcctactccttattctcctcatctgtcaaatgggggctaaaagtcctactttacaaaactgtagttgagattttaaaacactaacctaggtgataagacttggcaaagtctatgacaaaaagaaggaattttgtaagtgtttaatgaataaatgaatgggtgactcaaagtcaaaatagacctctgataatgaaagatgaataaaatgacactcctctgaacccttttttaacagtgggtaactcttaaagcatgagcaggcaaaaaggattcaagatcttttagcaggtttatgccatcacactgtgctatgtgcagaccaatgaggcaaggtccacatctacaaccaaaagagtccaaaaaggtagctgggcatggtggcatgtgcctctaatcccagctacttgggagactgaggctggagaataacttgggaggcagaggttgcaatgagccaagatcatgccactgcactccagcctgggtaatagagtgagaccctatctcaaa

SEQ ID NO: 29942 - DNA, 1136 bp, Homo sapiens
  misc_feature (959)..(959): n is a, c, g, or t
ctgagtcaggaatgaagggagaagtggtgtttaatgaaagccagtctggatcgtttgcacaagaaggactgggacagagagttgggggctggaaggagaggggaggagaaagagcctagtgcagatgttcagaaaaaaggtatagttatttggcaagaagctgcagatctcagagaaacataagatcccaaatctaagagcaagacattagccaaggaaagaacacccctgaaagtgacagctagcaatttctgcatcccagatggagttaatgtcaccaagagaacttgtactaggagtaggaggagactgacagcccccagggtctctcctcaggagagaattcagttatactgaagatgccttccaggccccccttggtcccttctgacgtcaccacagatgatcaggccaggggtgggagtctgaacagcagataattggccaaacaagtctatgaggtcacctgtcaaggaagaccttatcaaagagggacaatagtaattaactgaaaccatcaggtcctctcggagattcagaagggatccatgatgaatgtgtcattagttggcaagaagagcagacacagagagaatcagagatgcatgtgcagccacgatgtattggaacaggtgtccatgacccatgctgctgagaggccgcaggaatatccagtcttcacgcttctttggacttcgagcccacttcttaccggtaggtcctgggcatacaacataccactgcataatggtcatgagcacagactcgggagccaaaccacaagacttcaaatgctggctctgcgacttactatcagctgatttgagaccagctgctcggcctccacatgtctcagttctcttatgtacaagatgggcacctacctcctgaggttgttgtgaggattaaatgagttaatatatacaaatatttattatggtgtttggccaaaataagtnctatgtgtgtgattgttatcagcatttttggaatctctagttcttcctacaggaacgagtggtgaccccaccaactcactcacgcctgacatagcttctcacggggcctggctcatggtggaaaatcgcattttccttatttctgcttttataataaacttacctatcatttgaact

SEQ ID NO: 29943 - DNA, 991 bp, Homo sapiens
ctgagtcaggaatgaagggagaagtggtgtttaatgaaagccagtctggatcgtttgcacaagaaggactgggacagagagttgggggctggaaggagaggggaggagaaagagcctagtgcagatgttcagaaaaaaggtatagttatttggcaagaagctgcagatctcagagaaacataagatcccaaatctaagagcaagacattagccaaggaaagaacacccctgaaagtgacagctagcaatttctgcatcccagatggagttaatgtcaccaagagaacttgtactaggagtaggaggagactgacagcccccagggtctctcctcaggagagaattcagttatactgaagatgccttccaggccccccttggtcccttctgacgtcaccacagatgatcaggccaggggtgggagtctgaacagcagataattggccaaacaagtctatgaggtcacctgtcaaggaagaccttatcaaagagggacaatagtaattaactgaaaccatcaggtcctctcggagattcagaagggatccatgatgaatgtgtcattagttggcaagaagagcagacacagagagaatcagagatgcatgtgcagccacgatgtattggaacaggtgtccatgacccatgctgctgagaggccgcaggaatatccagtcttcacgcttctttggacttcgagcccacttcttaccggtaggtcctgggcatacaacataccactgcataatggtcatgagcacagactcgggagccaaaccacaagacttcaaatgctggctctgcgacttactatcagctgatttgagaccagctgctcggcctccacatgtctcagttctcttatgtacaagatgggcacctacctcctgaggttgttgtgaggattaaatgagttaatatatacaggtcttcggtgctgccattgctgctgctgaagttgctgctgtgcatgagctgccgtccaaaggcc

SEQ ID NO: 29944 - DNA, 338 bp, Homo sapiens
tggtgtaggaaatattttcacagaaatatttctcttttagagagttttttcggataaagaaggcttgtttaattcaggaagagttatttcataggaaattaaatctttgtaaatcctctatcacatttccacacttgctagttctgtggcaaatgatggctttcgagtggttcaggaagggtttcctgaaagcaaacaattccatgttttatacatatttgtgtttttatttttgaattggataagtaagggacatgtactttcccctttgtatttgtctctgggtgatattgctggttctcaaactcagaatggtaattaattacttataatgattt

SEQ ID NO: 29945 - DNA, 350 bp, Homo sapiens
ctatcattgtgttactatctctttctataggtttaataatatttctatttaaaatctgggtgctttgatgttgggtgcatagatatttagaattgttatatctttttgctgaaaagatttctttattattggatgattaccttctttaccctttttgttgcactttttatttaaagtgttttatttgatatacatacagatactcctgtttgcttttggtttctgtttctgttgatatctttcctcccttatttttaatctatatgtgtcttacaagtaaggtgagattcttgtaggcaccatagagttggacgattttttcttattcatatcataaatctatacatttt

SEQ ID NO: 29946 - DNA, 845 bp, Homo sapiens
agggcagggcaattaaagtcaggaagaaagagacctgcatattgatggatatattttgtgatccagccttatgtatgttctgaagagaaatacaaaatttgtatctaaatacctgtcctgtgtccctcttttcaaattcttctgttttttcttttttctttctgttttttttttttttttttttttctgttttgagacagagtcttgctctgcagcccaggctggaagggcagtggcgccatcttggctcactgcagccttgacttcctggggctcaagtgatcctcccacctcagactctagagtagctgggattacaagcatgcaccaccacgcccagctaattttaaaactttttataggagacagagttccactatgttgcccaggctggtcttgaatccctggcttgagtaaccctccttccttggcctcccaaagtgttgggattacaggcatgagccaccacgcctggatgatttaacttaaatttctcccatccaaatagcactaaagacaggcttgaaaaatccatgtctcactgacccttatctcagcatgctacgtgtactaacccactaaagctcataaaaaccctgtgagggttaggaagccaaggcaggcggatcacatgaggtcaggaatttgagaccagcctggccaacatagtgaaaccccctcctactaaaaacacaaaaaattagccaggtgtggtggtgcgcacctgtaatcccagctactcgggaggctgaggcaggagaaccgctcgaacccgggaggtgaaggttgccgtgagccaagatctgtcactgcattccagccagggtgacggagtgagattctgt

SEQ ID NO: 29947 - DNA, 375 bp, Homo sapiens
ataagaaaccatctgaaggtacaaaaaaacacaccaaaacttgacttgtactagtaagtgcaaagaagaacagaatgttataactgttaactatggtgtgtaaactaaattttcttaagtaaaaagactaaaagatgaacgagtcaagaataacaacctttcaagacacagacagtacaataggatataaatcgaagcaagaaaaagttaataagccaagcaacacagttaaagtgtagagtttcaatatttttgtttgtgcttgttagtttgtttatataatcagggttaagttgtcagcttaaaatgattagttatagaataatatttgcaagccttttgttaacttcaaatcaaataacatacaacaaatac

SEQ ID NO: 29948 - DNA, 186 bp, Homo sapiens
caagacatcaacaggagttaggcaaataaaatgaggaaagccataaaattagtatccaaatgtaaaaagcatctatcaagacttattcataattcaaatcaatatctcccaaagccttatcttattgaaattaaaatgtattattttcaatgccccttttctcttaccaaaaaaaggaagaaaact

SEQ ID NO: 29949 - DNA, 474 bp, Homo sapiens
gctgctgaggactgagaattgactgttagatttggcagcgcggaggccacttggcagcagctctttcagtggagtatggagactggagtctggcatgggctcatgagagaatgggaagagaggatttagaggtggtgattatgggcgactcctcggaagggtttcatggaaagagaactgggagtgccgggcagctccggggtttgtttgcttaaagacagaggaatgatggtagttgtgtgatgatgggaaagagctcgggaaggggagggccaggagagagagagtgcagggacagtggctggaatgatttcctgagatggccagaagggattgcatcgaagagcatggggtgcatgtcccttactcgtatctcgtctctctcagtaatgttttgttatgaaccttttgaaagttttgcataacctttcttgattgattcctagaaactagagtttttgttgttgttgttgt

SEQ ID NO: 29950 - DNA, 281 bp, Homo sapiens
gatcccggccatgctttagtagatgttgaccaggctgttctcaaactcctgccctcaggtgatctgcctacctctgcctcccaaagtgctagattacaggtgtgagccgcccactgggcctgcctggaaaacatttgttgaagtccgaagttgaaattctagagatgaaacctaaaacattttagatgaaaaatacactggatgggactaaaggcaggttaaacactacaaaggacaaagattagtgaagattaagacacagtcataacaatagaactatc

SEQ ID NO: 29951 - DNA, 385 bp, Homo sapiens
aagtttactatgttaatgtgttttccttaatataaaatttaattttttaaaacatattttaaaaacttccaaaatatagattgtgtgtgttatactgcttttaggtttgagaaagataaaagattttggtttttcttggttgagcacggtggctcatgcccgtaatcccagtacttggagaggccaaggtgggaggattgcttgggccaggagtttgagaccagtctgggcaagacttgtctctacaaaaaatagaaaattagctggacatggtggtgcatgcctatagtcctagctacgcaggaggctgaagcaggagcatcacttgagccccaggagatcaaggctgcagtgagctatgatcacaccattgcactctagcctg

SEQ ID NO: 29952 - DNA, 496 bp, Homo sapiens
ttgatcatatgatatattaggggtggattattcatgagttttctgggaattcttcctttcagaccatatagggtaacttccagatgttgccatggcatttgtaaactgctgtggtgctggtgggagtttaagtatggtaatgcattataattcacatataatgaccagtgaggacgaccagaggtcactttcatcgccatcttggttttggctgccttctttactgcatcctgttttagtagcagggtttttgtgacctgtattttgtgccaacctccaatgtcatcctgtgactctgaatgcttaacctcctgggaatacagggcaggagctttcagcctcattttacccaatgcctattcaagatggagtcactctggttccaaggcctctgacagacctagggcaagttccccaaatgtttgtttttaacaagcaccacaggtgaatgcaagggcagccagatttgggagccagtgagctatcaaacactttt

SEQ ID NO: 29953 - DNA, 452 bp, Homo sapiens
caaataaacatatacatatagtacatgtcaattagataagtccatgaggagaaatagataagggactagagaaatgggtaatgggagccctgaggttgttttttagatagaatggtcagtgcagacttctctgaggaagtgatatttgagagacctgaatgaaataaggagatgtgccattgggcgtggtagctcacacttgtaatctcggcactttgggaggccgaggtgggcagatcacctgaggtcaggagttgaagaccagcccgggcaatgtggtgaaaccccgtctgatctaaaaatagaaaaattagccaggtgaggtggtggatgcctgtagtcccagctactcggtaggctgaggcaggagactcacttgaacttgggaggcagaggttgcagtgacctgagatcatgccattgtactccaacctgggtaactccgtctcaaa

SEQ ID NO: 29954 - DNA, 325 bp, Homo sapiens
aaaaaaagtttttacccatgttataagggaaatttttgagctaactttagagtgtggtagttaatggtgagtttatttattaaagtgtttatttactatgtgccaggcgttattttaatgctgtatatatattaactcatttaatcctctaacataactagctactgttaggttagttagttattaataacataacagtaccagcagtgaaatagctactgttattttacaggtgaagaaactgaggcataaaagagatttcagtaacttgctgaagtcacacaaatattaggtggcagagctgggatttgaatttgggtcgacg

SEQ ID NO: 29955 - DNA, 1081 bp, Homo sapiens
acctttcaaaatcaatccagtgtgaaatattggttgcctgagaggtcagtcatacagaattgtgtgctttattatttgaaatgttatttgttttcagcctggtgcagaaatccttttccttcagttatattttagaaccactgtgtgagtacattactttttaggttttgggcctcatggacattcttagcaacttgttttcacagccctttctttgatgttcatttgaaccatagcgttgttgatattcagagtattttgacctacaaacataaacattttatatggttcaaactaacagttaatttgcttcagtttaccaggcatggatgagtacagtttcaatgctaatagcaaatattttacttattttactttcctgagcactttacatgttttcactgttttcctcctcacatcaacaaccccaatgaattttatctctcatttataaataaagaaataggtgtaaagagataaagtaatatgcccaagtaagtgggaaactcaggatttgaacccaactcctcttgctccagagtctacacgctgaacaacaatgctattccgccctctacccttgatctagtcccctcttggccatctggtagttttgtaaattcaagcatagctccttctatggccttgagcccctcctttccctgcacagtagagaggggttggacttttattggattgtgtttgtattgtaattgtgtgtttttccagatgtgttttctagccacaggaagagatactcaaataagtctttcaacagtatctattatgctgacattcacacttgtttgtgttattttgtacgttttggaagccttctgtagttaagtattagttgagctaattccttactgtttttgtgtcatactttgttatggagcaacgtaatatgtgtatgttgttaactgaatcgatagaaatctaagaatcaacttggtctatatcatctgatgattcaggggctggtttggatcattgataaagtaaattattccctgttttacttaactccttagtggcagttttctagattcccattattggcttgcatcaaaaaaaaaaa

SEQ ID NO: 29956 - DNA, 93 bp, Homo sapiens
catgtgcagttaaaatgtgttgcagggtctttctcctggggtcatggcctgttctctagtcagtggtttcaacgttgaaaaattaacttaaat

SEQ ID NO: 29957 - DNA, 737 bp, Homo sapiens
ggtctcaaactcctgagctcaagagatccacccactgcctcagcctcccgagtagctgggattacaggcgcctgccaccacgcttggctaatttttgtatttttagtagaggccgggtttcaccgtcttggctaggctggtcttgaactcctgaccgcaactgatccacccatctcggcctccaaaaatcctgggattacagccatgagccactgtgcccggctgaaacctgctttttaaaaactcaatactgcacaaagattttgccatgtcagctcatacagatttattccactcttcatgtatgttgcagggagtccacagatcagaactgatgaactactgtaccatctgatagcgcagccttaatgttgtcgtagatttttcactatcatattcaatgatacaaaaagattcttgtatacatacaatttccttttcatatgtgtgaatatctttctagggtaggtatctaggagagaagttctagactattagaggttttctgtattttacattttacaggtctcctggcatttaggatttatgtctgttattattactgacaaagataagagcttatgaggactggctggagaggtgatactctggcctagacagtacctgagcaagcccagaaaaccatcagataatctacaaactcactgaaattttattccttccttgtaaaatttaccaaggaaacatcatcatgatattttttagttagcacacat

SEQ ID NO: 29958 - DNA, 286 bp, Homo sapiens
tgtgtgaatttggtcaacctgtaactcagtggcttcagttaaacacatcagaatcttttcccttcttcagtgtacctgtacacatttgaaaatcaatattggcgatggttgtggaaaaagttagagaggagggggcaaagttaaattcagacctcaacagacctgtgaactatcatcttttcttttgttggaaggtgtgccagataacctgtgtaactaaatgttttaactgtctagtgactttgtcaccttggaggcaaaagtatgtcatcagtgaataagagga

SEQ ID NO: 29959 - DNA, 408 bp, Homo sapiens
tcacaatgtttttatggacaagttcagcccataaatcaaaaattacctttatggatgaaatattagttaagtcaagatcatctttttcatttcctacatgcaggttgaatctcatttatggagtgagatgtcaaataacaacaaaaaatgcacttaatttgcataaagatgcttgtaaggtaacattgctccacactttgctttattcacatcattagaggaaatatcttattcctctagctgtttctggccatggctcaaggaattaaaaacttccattcattccttcagacagtacagttaacaagaggataactttttttattatctctgtccttctccctcaggaagcagagaattatcagattggtgagagaaaggaaataaaggtctgaacatgtgtctcaa

SEQ ID NO: 29960 - DNA, 169 bp, Homo sapiens
  misc_feature (56)..(56): n is a, c, g, or t
caccttggcccagggcctcttacctccagatccttcagggtaacagatgatgcagnaagtaataaaaatgagaaattcaaaaaaacaaaaacttacatgggaaacagttatggatatagagaaagtataaaaacagcaatgagccaggcatggtggctcatgcacgtaa

SEQ ID NO: 29961 - DNA, 375 bp, Homo sapiens
acctctggctcctgggctcaagcagtcctcctgcctcacctcccaagtagctgggactacaggcgtatgccaccacacctggctaagttttatgttttttgtagagatgaggttttgccatgttgcccaggctggtctcgaactcctaagctcaagcaatccaccaaccttggcctcccaaagtactgtgattacaggcaagaaccactgtgccagcacatttttaaagttctaaaagaagaaaaaacttccaacatagaattatatacccagagaaagtatctttcaaaaacttaagtaaaataagcatttttttggacacacaaaaacagaaagaattcatcattcatagaccttcactaaatgaaatgttaa

SEQ ID NO: 29962 - DNA, 444 bp, Homo sapiens
agcaatgggctgtacccatagtgtgttctctcctgctactctctcttcctccccatccccctcctacattaaataaaatttttgctgtaaaaatttgaaagagatttacaaaatctatttacaattatttgcctatgagttaattatagattgactgatttttttagcaatctctctgcatacttagaaattcttttgagttgtaaaaaaaccaaaagtgtaacctttttgcaattgatattttttaaaataataaattctaagtgtaataattactaaaattggcataagcttccatttcagggataaacatttattaatttcacacttggatttatgttcatacattacagccaataattttgttcatatctcacatacttcagtaggtttttgtaaagcttataggctctaggccttgtgcctatagtgactcataagaaa

SEQ ID NO: 29963 - DNA, 344 bp, Homo sapiens
gttctcattcttgttcccataagccaggattggctgagccttagccaggataccacctggcattcagccacatcggctaaagagatgaggaacctgagaggaaacaaatgtgaggaagaggatgattcaagaggaccagaaatacaaggaaaggacagaggccctcggatggttcactgcagagaagacaggctgaaagatttaggaaccggctgaaagccaacatgccagagcctcccaaagggtggaatcagagatctctcctgctattattgtatcagcagcctcacgtctaccctcgggcctgaattttgttatagatttatacacatttgatatagagt

SEQ ID NO: 29964 - DNA, 415 bp, Homo sapiens
aattagcctggcgtggtagcactcacctataataccagctacttgggaggctgaggcaggagaagtgcttgaacctgagaggcgaggttgcagtgagctgagatcataccactgcactccagcccgagtgacagaatgagactccgtcaaaaaaaaaaaattaataaaaataaaaataaataaaagcacagaccctacagaaaagactgcctgggttcaaatcctgtgtccatgactcactctgagccttagcttcctcagctgttaaaaaagaaaaaaaaaaaaaaagggacaatagtagtctttacttcagaggacttttgtaagaattaagtgagttaagatggttataacatatagttctcccaaaacagtgcttcatagaagttttcattatcatcccccttcccacttt

SEQ ID NO: 29965 - DNA, 366 bp, Homo sapiens
gtcacaatctcgactcgctgcatcctcaacctcccgggctcgggtgatcctcccgcctcagcctcctgagtagtgtgcaccaccacacctggctaatttgtgtgttttttgtagtgatgggatgtcgccgtgttgcccagactgctctcgaactcctcactttgggcaatcctctctcctcggccctccagagtgttgggattacaggcgtgacacgcgcacccggccatctgttgcccttaaggaagttaagatacaaacactaggaatacatgcccttaattcaacccacacccccatgcttgtttggttttgttgggttttttggggatcttcttgtttgtttgtttttgagactccatctca

SEQ ID NO: 29966 - DNA, 406 bp, Homo sapiens
gggtaccaagatctgaagggtcacatccctgttaactggctctgttacaataaatactagcgataataaatatttatcaggtgtacataccatgccatatcctgttctgaagagtctttgaaattttaatagatttggtaaagaatttttgaacttaaataaaaggaaataattctggaacaaaatatgcccaagcaaaagtaaattgttttacattcttttcatatagaacagagaaatgcataccacccttgacaataggatcagaagaacaaacagtatcagatgttacagaacgtttttgaagtttttcactgtgtgagctgcatgggtctgcacagcacctcccacagtggttctgcattggccagttcaacctcatttcataccagtttttctgtttgtt

SEQ ID NO: 29967 - DNA, 448 bp, Homo sapiens
gaaacattaaatcaccccatgtgttctgttttggggtattgtattcatcacttaatctttatagcatcaataaatatagaactttatcatcattttaaatggctggagagtgatatttcataatatgtgtattgacagctccatcattatttcaaaatcgtcttatcctcacctttcactccagatattgccgttatggctagctacaaagaggcattgaccagctttgtgcagaaacaattcagtcatcttctcagaaatggtgctgaaacaactggatattcacatgcaaaaatgaacctcaatccctgcctcatttcatacataaaaattaaagtgaaatagatcatagccctaactgtaagatctaatagtataaaatttccacataaagtaggagaaaatcttttttgaccttgggttagacaaaaatttttagataggaccc

SEQ ID NO: 29968 - DNA, 655 bp, Homo sapiens
ctagagagcccatcccatggagttagttttgcgatacttgtagttctgggctgacatgtgggaaggaattgggaaacaggaaaatgtgcttgtgttgtttattgcagaaatccaagaacggtagcaatgtagttgacgccctcagcctagagtcttctgagagctcaccgtccttggtcattggttctaggagcacaactgggagtaggatgcataggcagtatgcagggccatacagtcaagaccgggactgctcagcctgggcgacagagcgagactctgtctcaaaaaaaaaaaaaaaaattatcagagagaatggtagctcttctctgctcatcgaggcattatctaacagtagccacaagtgccaagcagacattagacatatcctgaataagaatgggtaagtgtgcgtctgggaggagtggtaggggacagagcctttatgttccaattcttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcaaagctgtt

SEQ ID NO: 29969 - DNA, 1465 bp, Homo sapiens
caagggcccccagtcccgggtgccgcggggacagtgtagggtcattagctgttgagccgccccgggcgggcccaagcctttggatctcaggtgaccggcacaggcggccgcggggtccggaactgcttgttccggcagtggaagagacgcgccggcgttggccgctgctgctagcagcttgaaccccagggtcgggaccgatgtcggcttgggctgctgccagcctaagcagggccgctgcccgatgcttgctggcacgaggccccggggtcagggcggctcctccgcgcgacccccggccctcccaccccgagccccggggctgcggtgccgctccgggcaggacgctgcactttaccgcggctgtccccgccgggcacaacaagtggtccaaagtcaggcacatcaagggtccgaaggacgtcgaaaggagtcgcatcttctccaaactctgtttgaacatccgcctggcagtgaaagaaggaggccccaaccctgagcacaacagcaacctggccaatatcttagaggtgtgtcgcagcaaacatatgcccaagtcaacgattgagacagcactgaaaatggagaaatccaaggacacttatttgctgtatgagggtcgaggccctggtggctcttctctgctcatcgaggcattatctaacagtagccacaagtgccaagcagacattagacatatcctgaataagaatggaggagtgatggctgtaggagctcgtcactcttttgacaaaaagggggtgattgtggttgaagtggaggacagagagaagaaggctgtgaacctagagcgtgccctggagatggcaatcgaagcaggagctgaggatgtcaaggaaactgaagatgaagaagaaaggaacgtttttaaatttatttgtgatgcctcttcactgcaccaagtgaggaagaagctggactccctgggcctgtgttctgtgtcctgtgcactagagttcatccccaactcaaaggtgcagctggctgagcccgacctggaacaggccgcacatctcattcaggctctcagcaaccacgaggatgtgattcacgtctatgataacattgaataaccaggctacatgtgcccccgggttccttcctagaaatgtggcagcccattccagcacacaggcttctgcagcaatctctgagggtaaagccggtgggaggctcagcaggccaggaggcccaaggacaggacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcaaagctgtt

SEQ ID NO: 29970 - DNA, 1283 bp, Homo sapiens
ctgtgcaattcgggtgagttccttcacccttctgagccatcccttggctcgtctggaaaatgcaaaaaaaaaaaaaagaaaaacaccaggtttttgcatcctcctggatgagggatataaagtgcctgacacagcatatgacagggatttgataaatgggggctgttagctgtcccattgtggatgtgagaatagcattctgctggctaaaaggcagacatgaatgttctagaacatggcgatcccggaatgtgcagtgaaggcaggaagaggaagaatgggcagggaagaacaagttgggatggaggaatgaactcttatctccagaagcagagctaagaatgcccacggagccttggcacatgacagcctccgctgagccaaatggcccaaagacttctgaatgagcttttgctgcaacaaaaaactttggatcattttgagagcctcccgtgaggtgccaatatgttgcagtaccttcccggccccgacactgatgtgattcatcgtaggtaacatatgaataagaatggaggagtgatggctgtaggagctcgtcactcttttgacaaaaagggggtgattgtggttgaagtggaggacagagagaagaaggctgtgaacctagagcgtgccctggagatggcaatcgaagcaggagctgaggatgtcaaggaaactgaagatgaagaagaaaggaacgtttttaaatttatttgtgatgcctcttcactgcaccaagtgaggaagaagctggactccctgggcctgtgttctgtgtcctgtgcactagagttcatccccaactcaaaggtgcagctggctgagcccgacctggaacaggccgcacatctcattcaggctctcagcaaccacgaggatgtgattcacgtctatgataacattgaataaccaggctacatgtgcccccgggttccttcctagaaatgtggcagcccattccagcacacaggcttctgcagcaatctctgagggtaaagccggtgggaggctcagcaggccaggaggcccaaggacaggacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcaaagctgtt

SEQ ID NO: 29971 - DNA, 679 bp, Homo sapiens
caagggcccccagtcccgggtgccgcggggacagtgtagggtcattagctgttgagccgccccgggcgggcccaagcctttggatctcaggtgaccggcacaggcggccgcggggtccggaactgcttgttccggcagtggaagagacgcgccggcgttggccgctgctgctagcagcttgaaccccagggtcgggaccgatgtcggcttgggctgctgccagcctaagcagggccgctgcccgatgcttgctggcacgaggccccggggtcagggcggctcctccgcgcgacccccggccctcccaccccgagccccggggctgcggtgccgctccgggcaggacgctgcactttaccgcggctgtccccgccgggcacaacaagtggtccaaagtcaggcacatcaagggtccgaaggacgtcgaaaggagtcgcatcttctccaaactctgtttgaacatccgcctggcagtgaaagcttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcaaagctgtt

SEQ ID NO: 29972 - DNA, 741 bp, Homo sapiens
caagggcccccagtcccgggtgccgcggggacagtgtagggtcattagctgttgagccgccccgggcgggcccaagcctttggatctcaggtgaccggcacaggcggccgcggggtccggaactgcttgttccggcagtggaagagacgcgccggcgttggccgctgctgctagcagcttgaaccccagggtcgggaccgatgtcggcttgggctgctgccagcctaagcagggccgctgcccgatgcttgctggcacgaggccccggggtcagggcggctcctccgcgcgacccccggccctcccaccccgagccccggggctgcggtgccgctccgggcaggacgctgcactttaccgcggctgtccccgccgggcacaacaagtggtccaaagtcaggcacatcaagggtccgaaggacgtcgaaaggagtcgcatcttctccaaactctgtttgaacatccgcctggcagtgaaagcaggaggcccaaggacaggacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcaaagctgtt

SEQ ID NO: 29973 - DNA, 545 bp, Homo sapiens
caaatggaactacactttttaagtgatggatacatgctacttgggggtgggtgggtgtcgggaccgatgtcggcttgggctgctgccagcctaagcagggccgctgcccgatgcttgctggcacgaggccccggggtcagggcggctcctccgcgcgacccccggccctcccaccccgagccccggggctgcggtgccgctccgggcaggacgctgcactttaccgcggctgtccccgccgggcacaacaagtggtccaaagtcaggcacatcaagggtccgaaggacgtcgaaaggagtcgcatcttctccaaactctgtttgaacatccgcctggcagtgaaagcttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcaaagctgtt

SEQ ID NO: 29974 - DNA, 477 bp, Homo sapiens
  misc_feature (98)..(98): n is a, c, g, or t
  misc_feature (193)..(193): n is a, c, g, or t
tcacaatacttttaacttagggagtttggggccacatggaaaataagtggaagttgttctgaaataagcccccggtgattttccgtaatgaaaagganccgagatccttttcttataatgctcagcctcagagataaccattttggaggcaagaaattaataatttagttacaaagtgaagcttcactggtgnataccttatgatgtgaatcacaaggttgatctgatggtgagccatgggtgctcagatggggcaggtatagacagagagaagaaggctgtgaacctagagcgtgccctggagatggcaatcgaagcaggagctgaggatgtcaaggaaactgaagatgaagaagaaaggaacgtttttaaagtaagcatgaaaacatgggtgtttggtgggcttccgggaggaccctgatagatgccttatgcatgcctcttggtttcttccttcatgtgccccagggtataggt

SEQ ID NO: 29975 - DNA, 1285 bp, Homo sapiens
caagggcccccagtcccgggtgccgcggggacagtgtagggtcattagctgttgagccgccccgggcgggcccaagcctttggatctcaggtgaccggcacaggcggccgcggggtccggaactgcttgttccggcagtggaagagacgcgccggcgttggccgctgctgcactttaccgcggctgtccccgccgggcacaacaagtggtccaaagtcaggcacatcaagggtccgaaggacgtcgaaaggagtcgcatcttctccaaactctgtttgaacatccgcctggcagtgaaagaaggaggccccaaccctgagcacaacagcaacctggccaatatcttagaggtgtgtcgcagcaaacatatgcccaagtcaacgattgagacagcactgaaaatggagaaatccaaggacacttatttgctgtatgagggtcgaggccctggtggctcttctctgctcatcgaggcattatctaacagtagccacaagtgccaagcagacattagacatatcctgaataagaatggaggagtgatggctgtaggagctcgtcactcttttgacaaaaagggggtgattgtggttgaagtggaggacagagagaagaaggctgtgaacctagagcgtgccctggagatggcaatcgaagcaggagctgaggatgtcaaggaaactgaagatgaagaagaaaggaacgtttttaaatttatttgtgatgcctcttcactgcaccaagtgaggaagaagctggactccctgggcctgtgttctgtgtcctgtgcactagagttcatccccaactcaaaggtgcagctggctgagcccgacctggaacaggccgcacatctcattcaggctctcagcaaccacgaggatgtgattcacgtctatgataacattgaataaccaggctacatgtgcccccgggttccttcctagaaatgtggcagcccattccagcacacaggcttctgcagcaatctctgagggtaaagccggtgggaggctcagcaggccaggaggcccaaggacaggacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcaaagctgtt

SEQ ID NO: 29976 - DNA, 1259 bp, Homo sapiens
caagggcccccagtcccgggtgccgcggggacagtgtagggtcattagctgttgagccgccccgggcgggcccaagcctttggatctcaggtgaccggcacaggcggccgcggggtccggaactgcttgttccggcagtggaagagacgcgccggcgttggccgctgctgctagcagcttgaaccccaggtcaggcacatcaagggtccgaaggacgtcgaaaggagtcgcatcttctccaaactctgtttgaacatccgcctggcagtgaaagaaggaggccccaaccctgagcacaacagcaacctggccaatatcttagaggtgtgtcgcagcaaacatatgcccaagtcaacgattgagacagcactgaaaatggagaaatccaaggacacttatttgctgtatgagggtcgaggccctggtggctcttctctgctcatcgaggcattatctaacagtagccacaagtgccaagcagacattagacatatcctgaataagaatggaggagtgatggctgtaggagctcgtcactcttttgacaaaaagggggtgattgtggttgaagtggaggacagagagaagaaggctgtgaacctagagcgtgccctggagatggcaatcgaagcaggagctgaggatgtcaaggaaactgaagatgaagaagaaaggaacgtttttaaatttatttgtgatgcctcttcactgcaccaagtgaggaagaagctggactccctgggcctgtgttctgtgtcctgtgcactagagttcatccccaactcaaaggtgcagctggctgagcccgacctggaacaggccgcacatctcattcaggctctcagcaaccacgaggatgtgattcacgtctatgataacattgaataaccaggctacatgtgcccccgggttccttcctagaaatgtggcagcccattccagcacacaggcttctgcagcaatctctgagggtaaagccggtgggaggctcagcaggccaggaggcccaaggacaggacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcaaagctgtt

SEQ ID NO: 29977 - DNA, 1153 bp, Homo sapiens
ctagagagcccatcccatggagttagttttgcgatacttgtagttctgggctgacatgtgggaaggaattgggaaacaggaaaatgtgcttgtgttgtttattgcagaaatccaagaacggtagcaatgtagttgacgccctcagcctagagtcttctgagagctcaccgtccttggtcattggttctaggagcacaactgggagtaggatgcataggcagtatgcagggccatacagtcaagaccgggactgctcagcctgggcgacagagcgagactctgtctcaaaaaaaaaaaaaaaaattatcagagagaatggtagctcttctctgctcatcgaggcattatctaacagtagccacaagtgccaagcagacattagacatatcctgaataagaatggaggagtgatggctgtaggagctcgtcactcttttgacaaaaagggggtgattgtggttgaagtggaggacagagagaagaaggctgtgaacctagagcgtgccctggagatggcaatcgaagcaggagctgaggatgtcaaggaaactgaagatgaagaagaaaggaacgtttttaaatttatttgtgatgcctcttcactgcaccaagtgaggaagaagctggactccctgggcctgtgttctgtgtcctgtgcactagagttcatccccaactcaaaggtgcagctggctgagcccgacctggaacaggccgcacatctcattcaggctctcagcaaccacgaggatgtgattcacgtctatgataacattgaataaccaggctacatgtgcccccgggttccttcctagaaatgtggcagcccattccagcacacaggcttctgcagcaatctctgagggtaaagccggtgggaggctcagcaggccaggaggcccaaggacaggacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcaaagctgtt

SEQ ID NO: 29978 - DNA, 929 bp, Homo sapiens
caagggcccccagtcccgggtgccgcggggacagtgtagggtcattagctgttgagccgccccgggcgggcccaagcctttggatctcaggtgaccggcacaggcggccgcggggtccggaactgcttgttccggcagtggaagagacgcgccggcgttggccgctgctgctagcagcttgaaccccagggtcgggaccgatgtcggcttgggctgctgccagcctaagcagggccgctgcccgatgcttgctggcacgaggccccggggtcagggcggctcctccgcgcgacccccggccctcccaccccgagccccggggctgcggtgccgctccgggcaggacgctgcactttaccgcggctgtccccgccgggcacaacaagtggtccaaagtcaggcacatcaagggtccgaaggacgtcgaaaggagtcgcatcttctccaaactctgtttgaacatccgcctggcagtgaaagaaggaggccccaaccctgagcacaacagcaacctggccaatatcttagaggtgtgtcgcagcaaacatatgcccaagtcaacgattgagacagcactgaaaatggagaaatccaaggacacttatttgctgtatgagggtcgaggccctggtggctcttctctgctcatcgaggcattatctaacagtagccacaagtgccaagcagacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcaaagctgtt

SEQ ID NO: 29979 - DNA, 749 bp, Homo sapiens
caagggcccccagtcccgggtgccgcggggacagtgtagggtcattagctgttgagccgccccgggcgggcccaagcctttggatctcaggtgaccggcacaggcggccgcggggtccggaactgcttgttccggcagtggaagagacgcgccggcgttggccgctgctgcactttaccgcggctgtccccgccgggcacaacaagtggtccaaagtcaggcacatcaagggtccgaaggacgtcgaaaggagtcgcatcttctccaaactctgtttgaacatccgcctggcagtgaaagaaggaggccccaaccctgagcacaacagcaacctggccaatatcttagaggtgtgtcgcagcaaacatatgcccaagtcaacgattgagacagcactgaaaatggagaaatccaaggacacttatttgctgtatgagggtcgaggccctggtggctcttctctgctcatcgaggcattatctaacagtagccacaagtgccaagcagacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcaaagctgtt

SEQ ID NO: 29980 - DNA, 625 bp, Homo sapiens
cgcggggacagtgtagggtcattagctgttgagccgccccgggcgggcccaagcctttggatctcaggtgaccggcacaggcggccgcggggtccggaactgcttgttccggcagtggaagagacgcgccggcgttggccgctgctgctagcagcttgaaccccagggtcgggaccgatgtcggcttgggctgctgccagcctaagcagggccgctgcccgatgcttgctggcacgaggccccggggtcagggcggctcctccgcgcgacccccggccctcccaccccgagccccggggctgcggtgccgctccgggcaggacgctgcactttaccgcggctgtccccgccgggcacaacaagtggtccaaagtcaggcacatcaagggtccgaaggacgtcgaaaggagtcgcatcttctccaaactctgtttgaacatccgcctggcagtgaaagaaaggtgagaccctgacggtcacccagcactggctgccgctgccctctcagtgcccgcagcctcgcttgcctctcggaattgggcccacctagatctccggcccttcactttgttttccttccccagtacccaccattgcccacctcataaatcctcaaaacacctac

SEQ ID NO: 29981 - DNA, 246 bp, Homo sapiens
tcaaagcatttccttgaacaatggaagccaagataaatctacttatgctaagaaacaatagaaatgaaatttccactgggatcaagttcaacacagcttattagcatccctttcatgctaggtatttggcttagatatcaggttaggggttaggagaagagagtccatgaccattatactaaacatgaacgttcaccagagagtcatcaacttgtgttttacttcttcaaatgctctttctcattc

SEQ ID NO: 29982 - DNA, 459 bp, Homo sapiens
gaaccttccaagtcagggcttggcaatacatatttgacctatgaaactgttggtcaggtgagtcttgacatgaatttgtcagtaatcctcatctcatctgggtctctcctcttgcatgagtcagaagcctctgagggcagagccaccctatcaggcatctagaggttaccatgcaaattgaagacatgtgtccctgtccctgtgagctgactgtgagaggctgggtgctcacttctccatggccagtgctgggctcacatttggagactggcattctcaagcctaaatcagacctcagaaaggtgaagtatttacttcttctctgtggactgctggatacatagataatcattctttagtaaacattgtatgagtacaaaaacacacagaggcacgcagacagacagaaacacacacattccatagggccagccaaatttaaaagattagcctctctga

SEQ ID NO: 29983 - DNA, 503 bp, Homo sapiens
tttttttttttctccatgataaatgactctcaacttcttttccctcatttaattgcttatctacatacaatgcctggaaggaaataaatgtaatggcccgtagcagttggccttcaggtatcaagtttaagtccctttaagcagaacagcaaattgagcacagaatgaactggtttcatggtagcgtactgcaattagatgcaagaatagggaaagcagggtgcttcaattggtgacacaattagtatagcactgggggacttctctttccacttcttcaactccgcctgcattccgctggctgaagagttgatgacatccctgaaaaatcttccctctcttgtttctctgatgccacctctgtgttctccggcctcactggccacacttcctttacctcccaaacttttaactctgagtgtcccaaacttgtctcatcacctacccctgcttgcccagctccccagcctgtttccccttctgacacgggcactctccttctg

SEQ ID NO: 29984 - DNA, 1263 bp, Homo sapiens
aacatcctcagaatttctgtcttaggaggaagaccatcttataatgaagccattagtgcttttcctgtgtactagaaaatgggctaaggtctttgcatcttttactcattccatcctctccacaaccatagccctattattcttattttacaaagaagaaaactggggcttagagatgtgaagtcacttgtccaagatcacacagttaggaagcggtgaaggtaaggattggaatttcgttctgactcctaagccactgcactcaactggtgctcaattaaagatgtgattccaacttctgttttaatctacaaaaaggatagagtcttcgccatctaacttgggtgtccaatggtttctattagggccttttgtggctctttatttggttctaaaatgatgtaaggacaatctctgctctgtctacttgaaaatattcactaagccaatcattaatgggaaccaagttctagaggaaacttttaatctttttaaagggcagaaccactttcaaacactttaccagcacttccttttacatactagcaattaatgtgcacatcacaggcaaactcttgctaattcattgaatcagagatgaggaacagctgtttaagaactcagaaagagcacttggtttgtgtttgagaatgtacttaaaatttaaaggatagtcttgccttaaaaatattccataaccctgtctcttccatctcctcacttgtctagagtggtagagttctataaatatgcttccacttaaactttctttataaaacaatggagggaagaaataatagatgttttaaaatcctcagtttaaactcagctttcctttttttgcctcgagttacgagcctatgagagctgccatgggttgataagtttgaaatggtgaaaattaaactgaataaatgaaagaacccttagtgatttagcttagttctattctcagcaaaatctcagctaaatcactaactggctctaccctcttaggtgagtcacttgtcctttctagtcttccgatgcctcaactttgcatgcaggaggttgcactggattaattcttctctctctctttttttttttttctttccaagacagtcttgcactcttgcccaggttggagtgcagtggtgtgatcttggctcgctgcaacctccaccccccaggagaatctcttgaatccaggaggcggggttgcagtgaaccgagatcatgccattgcactccagcctcggccacaagagtgaaactccatct

SEQ ID NO: 29985 - DNA, 506 bp, Homo sapiens
gggaagtttagtggaaatattgctaggcaacataaagagcctacttgagattcgtggtcatgagttgaaggagaccagacagcaagattgtgtatgagggcacccacagagtaaatggagagttgaaattaatgcagttgtgattttaccacgtggatatgaagaagtgagggggagaagtacaaaggagttctcttaatgattgaccatggaatttaagctggctaagaaaggaagtgagaggccgggcgcggtggctcacgcctgtaatcccagcactttgggagactgaggtgggtggattacctgaggtcaggagtttgagaccaacctggccgatatggcgaaaccccatctctaataaaaatacagaaaaattagccgggaatggtggcaggtgcctgtaatcccagctactcaagaggctgtggcaggagtatcccttggacccaggaggtggaggttgcagtgagccgagatcacgccactgtactccagcctggacg

SEQ ID NO: 29986 - DNA, 405 bp, Homo sapiens
  misc_feature (124)..(124): n is a, c, g, or t
  misc_feature (395)..(395): n is a, c, g, or t
atgaaatcactgacttggatcttgggcctttgggctcttgcagcgtgtttcacacctggtgagagtcaaagaggccccaggggaccatatccacctggaccactggctcctcctcctccaccangttttccttttggaacaggatttgttccaccaccccatcctccaccctatggtccagggagatttccaccacccctttctccaccctatggtccagggagaatcccaccatcccctcctccaccctatggtccagggagaattcaatcacactctcttcctcctccttatggcccaggttatccacagccaccttcccaaccaagaccctatccacctggacctccatttttccctgtaaattctccaactgatcctgccctccctactcntgcaccctaa

SEQ ID NO: 29987 - DNA, 520 bp, Homo sapiens
gaggaattccccgccaagttgaaaagttgaacctgcctcccaaactttctcctgtagtccagacggggacgccctgagggagcgtttgtgtcagtaatgggaaatctgcaagctagacggaaatgacctgctagtgattgcgctgtaaagaagccggaatccacctcttgaaggcatgaagttcaggtgctggacactttttgattgtctttcgctcatacaaaaaaaaaaatgaaccactggacacaatggcttctgctagtaatcccaacactttgggaggctgagacaggaggatcgcttgaggccaggagtcagagacaaacctgggcaacatagtgtgattccatctttacaaaaaaaaaaattttaacttagctgggcatggttgtgtacacctgtagtcccagctatatgggaggttgagatggaaggattggttaagcccaggagtttgaatttgcagtgaactatgggtcgtgccacagcactccagcctggatgacagagtgagactctg

SEQ ID NO: 29988 - DNA, 1002 bp, Homo sapiens
  misc_feature (111)..(111): n is a, c, g, or t
atggagtcctcaggcaacccagagagcaccacctttttttactatgaccttcagagccagccgtgtgagaaccaggcctgggtctttgctaccctcgccaccactgtcctntactgcctggtgtttctcctcagcctagtgggcaacagcctggtcctgtgggtcctggtgaagtatgagagcctggagtccctcaccaacatcttcatcctcaacctgtgcctctcagacctggtgttcgcctgcttgttgcctgtgtggatctccccataccactggggctgggtgctgggagacttcctctgcaaactcctcaatatgatcttctccatcagcctctacagcagcatcttcttcctgaccatcatgaccatccaccgctacctgtcggtagtgagccccctctccaccctgcgcgtccccaccctccgctgccgggtgctggtgaccatggctgtgtgggtagccagcatcctgtcctccatcctcgacaccatcttccacaaggtgctttcttcgggctgtgattattccgaactcacgtggtacctcacctccgtctaccagcacaacctcttcttcctgctgtccctggggattatcctgttctgctacgtggagatcctcaggaccctgttccgctcacgctccaagcggcgccaccgcacggtcaagctcatcttcgccatcgtggtggcctacttcctcagctggggtccctacaacttcaccctgtttctgcagacgctgtttcggacccagatcatccggagctgcgaggccaaacagcagctagaatacgccctgctcatctgccgcaacctcgccttctcccactgctgctttaacccggtgctctatgtcttcgtgggggtcaagttccgcacacacctgaaacatgttctccggcagttctggttctgccggctgcaggcacccagcccagcctcgatcccccactcccctggtgccttcgcctatgagggcgcctccttctactga

SEQ ID NO: 29989 - DNA, 436 bp, Homo sapiens
agtgacgacctagaaaaggccattgaatttcataattacttagagctattcccaaatacaatggaattccttacttagaggtaaaatcctatacaggccagaaagtctggctacagagtccacgtttaagaactattccagtcttcatttccatgatacacacaatatcatttaagattaatggagaggaaattcatgcattgtgcacagcaggaatttttccattccagcagttacatgaaaaagtccgaagattaaaaaagaaatgtggggggaaaaaaaggtggcaagagatacaatttcacctaattcattagtagaccacatagagaaggggaagtagctccagtgaaaagtttaatgttttcacttcaaaaaagctaaagaataccacctcccctgactcccacccaatacagagtaggtaaaaaacaaa

SEQ ID NO: 29990 - DNA, 537 bp, Homo sapiens
gccagtagcgtggctcagtccaagtctgcaagcctcagaaccagggacgccactgggataattctcagtccaaggctgaagagcctagagttttgatatccaaagggcaggagaaggagaatcttccagctccaggagagacagagacagaaagaggaaaattttctcctcttttgtttttattcaagccgtgaaccaattgcatactgccacccacattgagagcggatcttccccactcagtccactgactcccacgccaatctcctctggaaacaccctcacagacacacccagaagtcatgtttcaccattctctaggtattccttactccagtccagctgccacctaacattaaccagcagcacacatccacgctgccagacattcgtcagttgcagttcaggttttcccacccaggtgctgattccagggaaggtttctgctctggcaaatcatgattctctgtatctacctttctgcctctccagtttgggggcagcaggttaccctgtgacctaattttctgatgaact

SEQ ID NO: 29991 - DNA, 346 bp, Homo sapiens
tttttttttgagacagagtcttgctttgttgcccaagctggtgtacattggtacaatcacagctcatagcagccttgacctcttggactcaagtgatcctcctgcctcagcctcccagggactacaggcacgccctactacgcctagctattgtttttgtttgtttgttttagtacagataagccttgttatgttgcccaggctggtctcgaactcctggggtcaagtgatcctcccagcttggctgcccaaagtactgggattacaggtgtaagccaccccacctggcctggatatttatattgtctcttttaagaggtcacaaagaacataaaaattggggaat

SEQ ID NO: 29992 - DNA, 660 bp, Homo sapiens
ttaaaaataattatggtttttgattatataactaatcaacaaacatacaaaacctatattcattctcagttgtaatggaaatccaaaataaaacaacattaagacacattttttttactggtataaatagtatttttctaattgataatattcaatgtaaatgcaaagatggtacagtgtagagtttctgtttggataattgggtggtcattacttttatcttcttgattttatttttttaaatgtctttaatggtgattttttttacttttataattaaaaaaattaaaagtgacaacatatatgtatagtaattaagaaaaatatcttctcgaattggggcgaatttgtaatcctatacactgggccaactggcatcagaacttccacggactgttgttaaagaatctgctcaaaaacagtgagatttttcagtgaagaaggcttatttccatctatcaggatctgctgaggcagcagaacagagaactatctgttgtcaatcagttcaaaatacttaataacaaaataggtgttatacagctatcatgagtcaaaggcagaattttttatagaaaagaacacactataatgattgaaacatgcatattcagcagagatttactccacagaattctaggcagcaggattaaaaaaaaa

SEQ ID NO: 29993 - DNA, 890 bp, Homo sapiens
cagatagtaacttcttatcaactttaaatactactagtatcttttcctaatttgtcatctgtgcattttgcctgtaaaatgtctaagtttgatgaagtcaaaatgtaggattttttttttcctaaaagatatatgcgctctttcccttcggtgtgccactgaagatcctggtgttgccatgggccgccgccccgcctgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagcctggaggctgcccgaatttgtgccaataagtacatggtaaaaagttgtggcaaagatggcttccatatccgggtgcggctccaccctttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaaaaaaaaa

SEQ ID NO: 29994 - DNA, 488 bp, Homo sapiens
agaatcgagccggtacccccgactagcccgacagtccgggtgcggctccaccctttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaaaaaaaaa

SEQ ID NO: 29995 - DNA, 455 bp, Homo sapiens
tcccgtaagggaaagttgaaaagaactttgaagagagagttcaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaaaaaaaaa

SEQ ID NO: 29996 - DNA, 729 bp, Homo sapiens
cagatagtaacttcttatcaactttaaatactactagtatcttttcctaatttgtcatctgtgcattttgcctgtaaaatgtctaagtttgatgaagtcaaaatgtaggattttttttttcctaaaagatatatgcgctctttcccttcggtgtgccactgaagatcctggtgttgccatgggccgccgccccgcctgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagcctggaggctgcccgaatttgtgccaataagtacatggtaaaaagttgtggcaaagatggcttccatatccgggtgcggctccaccctttccacgtcatccgcatcaacaagatgttgtcctgtgctggggctgacagagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaaaaaaaaa

SEQ ID NO: 29997 - DNA, 964 bp, Homo sapiens
cagatagtaacttcttatcaactttaaatactactagtatcttttcctaatttgtcatctgtgcattttgcctgtaaaatgtctaagtttgatgaagtcaaaatgtaggattttttttttcctaaaagatatatgcgctctttcccttcggtgtgccactgaagatcctggtgttgccatgggccgccgccccgcctgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagcctggaggctgcccgaatttgtgccaataagtacatggtaaaaagttgtggcaaagatggcttccatatccgggtgcggctccaccctttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaaggtatgtagtgctgcagcccccttctcccacctttgccccagcctcctgactcagttctttccattgctccttagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaaaaaaaaa

SEQ ID NO: 29998 - DNA, 357 bp, Homo sapiens
gctcaatcaacatttctggctgggctatctgatgtctgccgtgtgattcaaaggtgattcgaggtgaccctgaggatggcaggggtccagggagggtggagacccatgccatcctacaccctgctctcacctagtgcagcctcggccccttcctgtggagagggacagggacaggactcggtgcaggtgtgcagtgagtggctggcatctctggaggtcagtatgtgagggtgggggtcccctccaggcagctgcgagggcttggctgctcccagaactgcctggaacctggggagactgtaaacaacctcttgcaaccccaagaataaagctgccatgtgtgagggcttgctctga

SEQ ID NO: 29999 - DNA, 1203 bp, Homo sapiens
tgtccaataattctatcaattgctgagataaggctgttaaaacccacaactataatttattattttttagttctataatttttctcttcatgttgtttaagactttgttatttggtgcatatatatttggaattgttatgtttactggtgaattgatccatttattattagtgttgcagtctcctcactccttaatttagtgaggtccaagatcttgtcccacaaccaagagaataaggcacacaaataccagagagtgagtaaggcaaattaacattcattaaggcaacagaaaagctctcaggcaggcaagagtgggacccaaacaaggggttgccaggaaatgggggctggagttctgatccctttatgtgacagaaacaaggaagtcctttgtgggtcctgccttaatggaaggggtaaaattccctgctgggagtgttctgtctgtgcatacctaggtttggcagcagtgactccatcttgattattagtcataagtgcctaagcaaaattcatgggggcaccaaaactgcaatgctaatgatattacaattagctctgggtcaagttaaggacatttagttgatttattgaaacataattgggacagtcccttctgagagacatcttggtataagaggaagttgttaaccacatttccacattctagctacaccacaaaggtagtgcaggtgcattcccatgggtgctgtctttctcccaagacccttcctctctatctgcctagccagcctctaactgcctcctctgttgttagtaatgttctttgtaagattttttgaatctaacttctagattatcagatattaatatagccacttttgcccttttattgataaatatttccatggtatgtatttttatattattttactttcaacatactgatactattgaattaaaagtgtatttcttactatagcaatagttaaggttgcattttttaatttattcagctaatttctcttttgattggtgtatttatgtcacttatatttaatgtaattattaatgtactaacacctaagcatttcattttattatttactacatattcatttgttttgttctcatttttcagttttcctttttttttggacttactgtgtgctactcgagctttcatgttgctttacttacaatgtttgaatacatctacaatatacaatctttgctttg

SEQ ID NO: 30000 - DNA, 1239 bp, Homo sapiens
atgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacccggcgccgcgtccgcgcgctcatcgctgtgctctgggccgtggcgctgctctctgccggtcccttcttgttcctggtgggcgtcgagcaggaccccggcatctccgtagtcccgggcctcaatggcaccgcgcggatcgcctcctcgcctctcgcctcgtcgccgcctctctggctctcgcgggcgccaccgccgtccccgccgtcggggcccgagaccgcggaggccgcggcgctgttcagccgcgaatgccggccgagccccgcgcagctgggcgcgctgcgtgtcatgctgtgggtcaccaccgcctacttcttcctgccctttctgtgcctcagcatcctctacgggctcatcgggcgggagctgtggagcagccggcggccgctgcgaggcccggccgcctcggggcgggagagaggccaccggcagaccgtccgcgtcctgctggtggtggttctggcatttataatttgctggttgcccttccacgttggcagaatcatttacataaacacggaagattcgcggatgatgtacttctctcagtactttaacatcgtcgctctgcaacttttctatctgagcgcatctatcaacccaatcctctacaacctcatttcaaagaagtacagagcggcggcctttaaactgctgctcgcaaggaagtccaggccgagaggcttccacagaagcagggacactgcgggggaagttgcaggggacactggaggagacacggtgggctacaccgagacaagcgctaacgtgaagacgatgggataa

SEQ ID NO: 30001 - DNA, 1424 bp, Homo sapiens
atgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacccggcgccgcgtccgcgcgctcatcgctgtgctctgggccgtggcgctgctctctgccggtcccttcttgttcctggtgggcgtcgagcaggaccccggcatctccgtagtcccgggcctcaatggcaccgcgcggatcgcctcctcgcctctcgcctcgtcgccgcctctctggctctcgcgggcgccaccgccgtccccgccgtcggggcccgagaccgcggaggccgcggcgctgttcagccgcgaatgccggccgagccccgcgcagctgggcgcgctgcgtgtcatgctgtgggtcaccaccgcctacttcttcctgccctttctgtgcctcagcatcctctacgggctcatcgggcgggagctgtggagcagccggcggccgctgcgaggcccggccgcctcggggcgggagagaggccaccggcagaccgtccgcgtcctgcgtaagtggagccgccgtggttccaaagacgcctgcctgcagtccgccccgccggggaccgcgcaaacgctgggtccccttcccctgctcgcccagctctgggcgccgcttccagctccctttcctatttcgattccagcctccacccgccggtacttcccatcccccgagaaaaccatgtcctgtcccccaggagctctgggggaccccagggcgctttgagggtgggatccccggatccgattcagtaaccagcagtgcttttccagagcctctgagaccagaaaggagagttggtaattcttaatccaaccacctgttagatgccacagatgaggagtcctcacagtgctcttgagaagacgagggagatttcattaagctaaaattttttatttaatgttaagtgatgctgaaggctaaagtaaaccttgctcgtatcaaaaagtaaagattgtgcagacctgttgtagaattcttttcaacagagaacagaaaacttgtctccgaagtgggtttgtgga

SEQ ID NO: 30002 - DNA, 461 bp, Homo sapiens
caaatagtgaatgattacactgacaggaacatacttgtggaaaatgtgcctgtgcctgtttttacaaaagaccctttccatggcaacagaaattttcatgtattagttgggaatactctaccctaatcaaaatcagaaactgtctttaccaagtgatgaaaggcagtgatgatagctgagggtgagcacgagatcctgatatatagaaatacttttatgtttggccagataatatgcctccatatgcctctttgagaatggtttggaaatgcttcatcagtcatcgtcagaataactactctacagagaactcagtatttaggaagaagagcaaaaaaaaaaaaaatgtccaccaggtacttcaatgcctattatgttctgggatacaaaatgaatgaggcacacctctgccctcatggagttcacaagccagccaacgcagagagaaagtcatcccccac

SEQ ID NO: 30003 - DNA, 263 bp, Homo sapiens
atgtaaaccttagaaaatctgatgactatgtgttgtattatttagttctagtactgctataaaggaatacctgagactgggtaatttataaagaaaatatgtttaattggcttatggttttataggctgtataggaagcatagcagcttctgctttgggggaggattaagaaaacttacaatcatggtagaaggcaaagtgggagggaagcatgtcacatggatggggcaagaggaaagttgcaggggatgtgctacacattt

SEQ ID NO: 30004 - DNA, 1005 bp, Homo sapiens
aaaaaatatatgtatacatatcatatatatatataaaataaaacttataaatagtttttatggctgggtgaagtgactcatgtctgtaattctagccctttgggaggctgagcgaggaggatcacttgagcctaggcattcgagcccagcctgggcaacattgcaagactctgtctcatttttttatataaaatgtttttttaaaaaaccctatgtataattatttattttttttccccaaggattattcccaaactatgtacaattaatgggttgccttgcagagttggatcaataatacctgacacacttgtatagcaagcatacactttacatagttcctcgcatctattctttgaaacccagacacattctagtattgggcactagaaactggtgataaataataacaattacatatatttcctgaagaattatgtggcattccttgttttaagcacctttgatgccttagctcaatctccattacaatactatgatataagtaccatttaatatttctttttgacagatgggaataatcgaggcctagggagattaaattacttggccaggttcatgtaagtggcagatctaggattcaaattcagccggtctgaatctagagcctattcttttagctatgatgctatactttaatacagtaatacactgttcaaatgaaactgtaacatgtcattaaatttgaacttgtcaataaacataccaagcaataaaataattacagcttgtggaaagtgcttatgaaaacagtaaataagctacttgagaatggtcaaggaaaggtttctttgatgtgctatatgtacattcaacagacacatggaggatgaaaaggaaacagccatgcaaagagttcaggggaaagactggcccaggtgaagagaacgccaagcacaaaaaccctgaaacaggaaaaagtttggtttgacaatggaattgccgaaaggctggtgtgactgaagtattgtgcgtgaaggagta

SEQ ID NO: 30005 - DNA, 611 bp, Homo sapiens
tatcacacaataattccggaatggaaaaaatagcctctggtactgaaaggagattagtggctgcatgggaactgggttggttgggtggagcgagacagctattgactgcagataggcataaggaatcttaccgaagtgatgggaataatcgaggcctagggagattaaattacttggccaggttcatgtaagtggcagatctaggattcaaattcagccggtctgaatctagagcctattcttttagctatgatgctatactttaatacagtaatacactgttcaaatgaaactgtaacatgtcattaaatttgaacttgtcaataaacataccaagcaataaaataattacagcttgtggaaagtgcttatgaaaacagtaaataagctacttgagaatggtcaaggaaaggtttctttgatgtgctatatgtacattcaacagacacatggaggatgaaaaggaaacagccatgcaaagagttcaggggaaagactggcccaggtgaagagaacgccaagcacaaaaaccctgaaacaggaaaaagtttggtttgacaatggaattgccgaaaggctggtgtgactgaagtattgtgcgtgaaggagta

SEQ ID NO: 30006 - DNA, 510 bp, Homo sapiens
gacatgggttagttcagcttgaagagctaggaagaagaaaagaaaggagaagactgaaggtggcccctccagaaacactgcagactgtcagccttgtcaaatgcttgggttcttgcatgaagcgctcccttttccttgtggcttagtggcagcaagtatgaaaaatggaagtattgatggaaaaaatatacattggcagaagatgggtagttggggactctattggttagaaatgcacatgcaaacggctgggcgtggtggctcacacctctaatcctagcactttgggaggccaaggcaggtggatcacttcaggtcaggagtttgagaccagcctggcttctactaaaactacaaaaattagctgggcgttgtgatgtacgcctgtagtcccaactactcaggcttctggggcagaagaagcacttgaacctggtaggtggaggttgcggtgagccgagatcatgccactgtgctccagcctgggtgatagagtgaaactccgtctcg

SEQ ID NO: 30007 - DNA, 930 bp, Homo sapiens
atggggttcgttctcctgaggctctctgcccacccagagctggaaaagacattcttcgtgctcatcctgctgatgtacctcgtgatcctgctgggcaatggggtcctcatcctggtgaccatccttgactcccgcctgcacacgcccatgtacttcttcctagggaacctctccttcctggacatctgcttcactacctcctcagtcccactggtcctggacagctttttgactccccaggaaaccatctccttctcagcctgtgctgtgcagatggcactctcctttgccatggcaggaacagagtgcttgctcctgagcatgatggcatttgatcgctatgtggccatctgcaacccccttaggtactccgtgatcatgagcaaggctgcctacatgcccatggctgccagctcctgggctattggtggtgctgcttccgtggtacacacatccttggcaattcagctgcccttctgtggagacaatgtcatcaaccacttcacctgtgagattctggctgttctaaagttggcctgtgctgacatttccatcaatgtgatcagcatggaggtgacgaatgtgatcttcctaggagtcccggttctgttcatctctttctcctatgtcttcatcatcaccaccatcctgaggatcccctcagctgaggggaggaaaaaggtcttctccacctgctctgcccacctcaccgtggtgatcgtcttctacgggaccttattcttcatgtatgggaagcctaagtctaaggactccatgggagcagacaaagaggatctttcagacaaactcatcccccttttctatggggtggtgaccccgatgctcaaccccatcatctatagcctgaggaacaaggatgtgaaggctgctgtgaggagactgctgagaccaaaaggcttcactcagtga

SEQ ID NO: 30008 - DNA, 307 bp, Homo sapiens
gtatcttcaaaataagccaagcatctgactacttcttatcacctcctctcttgctactctggttctagctgccatcatctctggcttgaatgactgtgataatctcttaactggtaaccctgtttctacttccctaacatcactcattctcaaaagagtgattcgttaaacatgtaagccaggtgatatcattcctttgttgcaaatcctcagtattacctagaataaaagccaaagtccttacagtgatttagaaagctctgcccagtctctgaccctctcccaggcactcaggctccttctgccc

SEQ ID NO: 30009 - DNA, 435 bp, Homo sapiens
tattatgacttacatttctataaaatcacaatcttcagcctctgtgtgcattaatgactttattttttctacctttttaataagcattcactttgttttatgaccctcaactaatataaaaagaaattatcttagtcaggcgcagtggctttatgcctataatcccagcactttggaaggctgaggcaggcagatcagttgagctcaagaattcgagaccagcctggccaacatggtgaaaccctgtctctactaaaactacaaaaacaaaaaaaattagccaggcgtagtggctgtagtcccacctacttgggaggggaaggcagaagaatcgcttgaacctaagaggtgaaggttgcagtgaccctagattgtgccacagcacttcagcctaggtgacatggcgagactccgtctcaaaaaaaaaaaaaaaaa

SEQ ID NO: 30010 - DNA, 345 bp, Homo sapiens
tttttttttttaagcttgggtaaaaacagggtccagagaatcttgaagtttcaattgttttcagttactcagcttttccctaactgcccaccatctttctggcctcccaaaatgacttcattgccatgaattaagagttgacccaagagctggctgaaaggcatcagaaaaaaagaaaatggcattacctaaaatatatgtcctcattaccattcatttcatatatatgatattcattttcacattttctatctcctttacttttcaaagtgaggcacagaaacactgaactacagaaagcaaagggcaaaggatggagctcggatttgaactgaattacaaagc

SEQ ID NO: 30011 - DNA, 402 bp, Homo sapiens
agcgcaccctcgccccaatttcacctgtcaaatctttgcactgtaaacagcagacccacgctcctcttttccaagatcctgcatccaggcctgccaaagcccagagctatttgtagatgttggcgaggacacgtctctctgtctgctcagtcaataattcactgcaataccaggtattgcaaaagaaggcctttgccttgccttccaataagagttacagggtagaaagcagaaacctgccctgcagctgccatgaaccccacctgagcaggcaagttaggctacacttgacagtggaagctcatcagccacagtgaagcagcccccaccacttgtttatttatttatttccctttgcacccaaccctgctgtgggcgccccccccccaaccaggctctcag

SEQ ID NO: 30012 - DNA, 483 bp, Homo sapiens
atgggacgatgggtgtccagcagaggaatgggactggtagtggaacctaaatttgtacttctatgtataatatgaagcaaatataacaaaaaattagtatttgttcattgtaggtgactaaacagctgtttaatatattgtcctttatatttttccatacaagtattttaattttttttttttttttgagatggagtcttgctctgttgcccagcctggagtgcagtggcacgatattggctcactgcaacctctgcctcccaggttcaagcaattctcccgcctcagcctcccgagtagctgggattacaggtgtgcgccacaatgcctggctaatttttatacttttaatagaaacaggatttcatcatgttggccaggctggtctcgaactcctgacctcaggtgatccgcccgccttggcctcccaaagtgctaggattacaggcatgagccaacacgccagcaccggccaagtgtttt

SEQ ID NO: 30013 - DNA, 817 bp, Homo sapiens
ggctgctccatgcctgtgctgtgcatcatgggccacaagcctcatgtgactgttgacacctaaactcactcatgccagctaaactcattcacgccagttaaactcattcatactagctaaactcatttgtaccagctaaactcactcacaccagttaaactcactcacaccagttaaactcattcgtaccagctaaactcactcatgccagctaaactcactcacgccggctaaactcactcgtaccagctaaactcattcgtaccagctaaactcattcataccagctaaactcactcatgccagctaaactcactcacgccggctaaactcactcataccagctaaactcattcgtaccagctaaactcattcgtaccagctaaactcactcgtacccgctaaactcactcataccagttaaactcactcatgccagctaactcactcatgtcagctaaactcactcatgccagctaaactcactcatgccaattaaactcattcgtaccagctaaactcactcatgccagccacacttcaggtgctcactggccgcccatggttagcggccacttccggcccagcatgtgctgctctctgtcttctggtgggcgtgcagtggaggctgcctgtgctctgattctgtcttcttgatgaactgtgaggccgagcaccttggatagccttctttgtcttttgcccattttcctcttagctttcattttcttattattaataggaattctttatatattctctgtatgattcctttgtcaagtatgtatattaaaaatattttctattcactttttac

SEQ ID NO: 30014 - DNA, 389 bp, Homo sapiens
ggggaatcgcttgaatccgggaggcggaggctgcagtgagccgagagcacactgttgcactccagcctggcaacaagagcaaaactcagtctcaaaaaaaaaaaaaaaaagctccaaatgggtacctggaatggaattggtgccactcagctcctttaggggttaacatgttgtcaaaatgcagggaggtggaggttgcaggactcagctggggagactgtggtctgatctgaaaggttgcccacaggtgtctgcctgcagcgatgtggggatctggttgatagtgaggcatttcttcacgctgtcaatgggacagcagttctctgtagagagacctggccgacttagcttgtctgaggagagtacagaatcttcctcggacccctgga

SEQ ID NO: 30015 - DNA, 291 bp, Homo sapiens
acagatggagacatggaggctcccagcaagtgaggagtcaccgcagatcagagaaccgctggccacaaaccttacctaaattccagatcttgctgtttctgctctacctttctagcatatccacaaaattattaaaatagcaaatgttttctttaaacatggcttcttaaaggtgtgtgtgggggcgggggaataaagatggcagagccggggttggagaacagtgatgtcagctgtttgctttctggctcctaagggttttactttgccattcatgagacaaaaaaaaaa

SEQ ID NO: 30016 - DNA, 427 bp, Homo sapiens
cttcccacaccaccaagcaagcaatcaattttgtaggggacaacatctgggtatccctcaattcaattcaatcctgatgctatctacctggagatagcttcagaaaccacaggctgagggctcagtcacataaggccaccctctccttcccatcagacctgccatggcctttccagggaccagcctcatcccaaagctacctaggggctgccaaccatcatcaactcactgggatacaaagacatcattttgaagtttccacagattttaggagttgtttaccaggaaacagaatcaaagaccaaatatatatttcacagtgtcacagtaaggaatggaattaccaaaataagggtaggcagcaattctaatggtcaactgatccatactgtggtacatagaggcctaggagaagaatttccaaggc

SEQ ID NO: 30017 - DNA, 3457 bp, Homo sapiens
cgggctcacgctcttcttcgtggtgctcggctctctgtcggtgcaagtgttcagcttccgctggtttgtgcacgatttcagcaccgaggacagcgccacggccgctgctgcctccagctgcccgcagcctggagccgattgcaagacggtggtcggcggtgggtctgcagccggggaaggcgaggctcgtccttccacgccgcaaaggcaagcatctaacgccagcaagagcaacatcgccgcggccaacagcggcagcaacagcagcggggctacccgggccagtggcaagcacaggtctgcgtcctgctccttctgcatctggctcctgcagtcactcatccacatcttgcagctcgggcaaatctggagatatttccacacaatatacttaggtattcgaagccgacagagtggggagaatgacagatggaggttttactggaaaatggtatatgagtatgcggatgtgagtatgctgcatttgctagccacctttctggaaagtgctccacagctggtcctgcagctctgcattatcgtacagactcatagcttacaggccctccaaggtttcacagcggcagcttccctcgtgtccctggcctgggccttggcctcctaccagaaggccctccgggactctcgagatgacaagaagcccatcagctacatggccgtcatcatccagttctgctggcacttcttcaccatcgccgccagggtcatcacgtttgccctctttgcctcggttttccagctgtactttgggatcttcatcgtccttcactggtgcatcatgaccttctggatcgtccactgtgagacagaattctgtatcaccaaatgggaagagattgtgttcgacatggtggtggggattatctatatcttcagttggttcaatgtcaaggaaggcaggacacgctgcaggctattcatttactattttgtgatccttttggaaaatacagccttgagtgccctctggtacctctacaaggctccccagattgcagacgcatttgccattccagcgctgtgtgtggtgttcagcagctttttaactggcgttgtttttatgctgatgtattatgccttctttcatcccaatggacccagattcgggcagtcaccaagttgtgcttgtgaggacccagccgctgccttcactttgcccccagacgtggccacaagcaccctacggtccatctccaacaaccgcagtgttgtcagcgaccgcgatcagaaattcgcagagcgggatgggtgtgtacctgtctttcaagtgaggcccactgccccatccaccccatcatctcgcccaccacggattgaagaatcagtcattaaaattgacttgttcaggaataggtacccagcatgggagagacatgttttggaccgaagcctccgaaaggctattttagcttttgaatgttccccatctcctccaaggctgcagtacaaagatgatgcccttattcaggagcggttggagtacgaaaccactttataaagcaaaaggagttgcaggacccacaacatccagatgaaggggtgacagcagggctgtggccataatgacacttcatcctagagcagggcagtgagccgtgaagttcctagtgggaccgtcatcaccattatcatttgatcctgtcggctgggggcggctggtctccttccaaagcagctgcacccgagagtctctgactccacctgaaagaatgacgctggcttaataggactctccattgctaccaaactcctcctgcacggtcttgggtgcacccaccagagggtactactattatggaaaaattttgcctccaatcattagggtgtcttgatggcgttaactgatctttccataaaaatagattcagtcatacacacatacacacactaacacacataagttacaccagtcctctgtcaaaaaagcttaggtgacttttcttgatgcaaagctctgattcccacaggaatataaaaacaaagaaagagggaaacatccctcgagaaaaaaaatagtattgcttagaaaagaaaccattttctcatttggaaatccataccatgtgtgaaaatcctatccaacggacagcaaacccaaatgttgtctacacatgtgttagcattgatggagtggttcattttctacacatttcaggatttgttttatattttaaattttcagttgcgaacatcctttttgacagaaatcctatgcagcccatgtacggctttcaacaagaccaaggagctcaataacttcatgatgtaaattaaatagtaatcatgattcagtattcaattgcaaaaatgtaacaggtacacaaagaggaagtggggaaaaaggcaaaatgagagtctgattcccaggcatgtgcagcgcccattgggacataacggcagtgcggcgcgagcagaaggaatgggctggaaccggatctgtttccagacgcagaatgagtggctctgtgtgaccataggcagatgctgactctggaagactccgtgccactcctttctagtgccaaacaccatccaaccacaggactgacgtggaagccccaaacaactgagaatgagtggcatgagccccctaaaagcaggcgagagaacgagcaatcaagttctccactgtgtacagacttttcctccccccaatccaaggtcaaagtgatgtgtcttttagaggctttggggacactttttagtaagtatgagcagacaaatgcaatgaatatgctatgaaaaaacccttcttgaactgaggagagggctttatcactatatccagctaagatttgtatttgaatcatctgtaaagtcgcactcttacaacaagcttctgggttttaaatacctccgtacagcaagtaaacgttccccgctttctgttctcagtgtcctcggtcatggtgcttttcgttgcattaaaagtgccggtcaaactttgatagtatttttttatagttggtgcagagtggaataactcatggattatttcaatatttttgtaataaaaaatatagggtatacacataggcatcatcacattttttatagaccctggaatcgtttaaaatactttaagcatcataattacttgggatgtcagaaactggtcccacaaattccatcagcctgcctcagcagattgaaaacatttgtctcttgcaagatcaccctactttgcaagttggtgcccccaggaacctggccaggggtgctatcagaatatcaggtgaagagagaatcagcttaaatagaaagggcttgtcaagactggccaatgtttcccaggaaatcaaagatgtaaatgattactttcatccatccattataacaaacctgaccacagtggaagctgtcttaaacttccttccctggttttatattaacccaactgatagattaagtattagtcaaaccactaaaaaaaaaa

SEQ ID NO: 30018 - DNA, 1651 bp, Homo sapiens
gtttaccgagagagcccgtccaagttgggctccatcgctgccctcgctccccttcggggcccccgcccgcctgggaagcagagagaaagccgggcccagcccttcctcacccttcccctccccgcaccgcccggagaggtcgggtaagggggaaggagtgtgcgtgggacggggaacctcgggcctggggatctggctgtccccgtccccgtacctcgcgcggacccgggagttccagccctaggccaggctccggctccctccgccccgcgccatcgcgctcggagtgacgggcccaccccgggcgagcagccagaggctggatctcagggatgccagctccccagcggaagcacaggcgtggaggcttctctcacagatgtttccccaccccgcagacggcgatgaccccccagcccgccggacccccggatgggggctggggctgggtggtggcggccgcagccttcgcgataaacgggctgtcctacgggctgctgcgctcgctgggccttgccttccctgaccttgccgagcactttgaccgaagcgcccaggacactgcgtggatcagcgccctggccctggccgtgcagcaggcagccagccccgtgggcagcgccctgagcacgcgctggggggcccgccccgtggtgatggttgggggcgtcctcgcctcgctgggcttcgtcttctcggctttcgccagcgatctgctgcatctctacctcggcctgggcctcctcgctggctttggttgggccctggtgttcgcccccgccctaggcaccctctcgcgttacttctcccgccgtcgagtcttggcggtggggctggcgctcaccggcaacggggcctcctcgctgctcctggcgcccgccttgcagcttcttctcgatactttcggctggcggggcgctctgctcctcctcggcgcgatcaccctccacctcaccccctgtggcgccctgctgctacccctggtccttcctggagaccccccagccccaccgcgtagtcccctagctgccctcggcctgagtctgttcacacgccgggccttctcaatctttgctctaggcacagccctggttgggggcgggtacttcgttccttacgtgcacttggctccccacgctttagaccggggcctggggggatacggagcagcgctggtggtggccgtggctgcgatgggggatgcgggcgcccggctggtctgcgggtggctggcagaccaaggctgggtgcccctcccgcggctgctggccgtattcggggctctgactgggctggggctgtgggtggtggggctggtgcccgtggtgggcggcgaagagagctgggggggtcccctgctggccgcggctgtggcctatgggctgagcgcggggagttacgccccgctggttttcggtgtactccccgggctggtgggcgtcggaggtgtggtgcaggccacagggctggtgatgatgctgatgagcctcggggggctcctgggccctcccctgtcaggcttcctaagggatgagacaggagacttcaccgcctctttcctcctgtctggttctttgatcctctccggcagcttcatctacatagggttgcccagggcgctgccctcctgtggtccagcctcccctccagc

SEQ ID NO: 30019 - DNA, 251 bp, Homo sapiens
aggtcaaggagaagaaccattagttcgagggaggcaaacagccaatgagaagtgttggagagagtttgggggcccgggggcgtgtcttccgttgactccgccccctttcaggccccgtgggcagcgccctgagcacgcgctggggggcccgccccgtggtgatggttgggggcgtcctcgcctcgctgggcttcgtcttctcggctttcgccagcgatctgctgcatctctacctcggcctgggcctcctc

SEQ ID NO: 30020 - DNA, 310 bp, Homo sapiens
aagtaactcagaaaaggctgggtctaacctggcccttacctaagaaatcctaatttaaagaaatgaagttttctgtaatgtatttttaagccaaataacaggtctctgacatccaaagaatgggaagaaagtgataatcaatgaaatatattaaatacgtacagaaaaccaacctcttctttcaatctcctcacagaaaaaaaaaaaaaatctttttttgctgggaagtatacaatggaaacctctaacttgtatgttaatttgtataactcaattgctcagaaatatttgaaatagctaccagtttaga

SEQ ID NO: 30021 - DNA, 317 bp, Homo sapiens
aataattaaagaagaaaaaattcccaaatgttgcctatttaatggtttatttaaagacaaggtcgaattcagccttaaaaccttgattatctaacaatggttttccaatacactttagcagatgagccctcttttcaagccaaatctcccctaaattctagttacaaaatacagaaaaagcaaagttctgtttgtagttgaggaggaacataggaccacggtctggcttatctccctccatacctgtaactgcattcacaggggcctctagcacttcaacaactcagtagggaagggattatggtgccccagacctt

SEQ ID NO: 30022 - DNA, 325 bp, Homo sapiens
gtctctgcatctctccctcaaattattaattaattgtaaagaaaaattttttggtgaagctaggagatacacctttatcaagagattgaagttagtctaggcaacatggtgaaaccacatctctacaaaaactacaaaaattggcggggtgtggtggcatgcacctatagtcccagctacttggggggctgaggtaggaggattgcttatgactcagaggtcgtggatgcagtgagctgtgttcatgccactgcactccagcctggatgacaaagtgagaccctgtctcaaaaaaataaataaagggattgaagttaataccctc

SEQ ID NO: 30023 - DNA, 413 bp, Homo sapiens
aactagcagaggcaggaagaagccagaaatggtaactaattattttgcatttactcactcttctgatatctgactcattattcaagggctcctccagtgaatttaccttgccagtttccccatattttcatataacattaaagaacacagtaaatgcgggtgatcccttcataatcaacatgcttctaatatgtcaggggtctctaggttacaaccaatatattcactgatttgttttccaaagacaggatgaggttgctgagtaaaacagcttcatgaaaaaaagggagcagctaccctctgagcaggctggtctatccagagtggactcaacacagagctatagatttctagggatttctgagcaggatgtccagaatgagtgtgggacttgaggtcttatctttaggcca

SEQ ID NO: 30024 - DNA, 368 bp, Homo sapiens
acacctttaaatgagttagaagagtaactactattcatagaataaaaatcaaatataactttcaaaccactaaagcgggaaaaaaactggaaaaaaagactgtcaaaccaaaggcagtaaagagaacaggaagcatgatacatagaaaaaaatgagtgagatatatctatgaataagttaagtgttagtattaacagggagaaatctcaaatgagggggacatgtacatgcttttaaaaaacataccgaaaacaaaatagagttaataactgcattagctttatagtcagagaaactcttgcacacgtgtaccaggaaacatgtacaagaaaatttactgtcagcagttggtaacagcaaaaaaaaaa

SEQ ID NO: 30025 - DNA, 83 bp, Homo sapiens
cccaacctcactcctccgaagactctcctggagatcatctgtgatgtgcagatacccagactcactggccccgagactcagat

SEQ ID NO: 30026 - DNA, 316 bp, Homo sapiens
caggggcttagagagatgtttcagtaaagaaacataggaaattaggtaggtagggtcatctataatgagtaaaaagacagcgtacttttgactgtgaacgtctgtagggcaaggacaaaacgctgacaatctttatttctgtctctatagtgctgaattatcacaagggacaaatggcctgaataattgtatgaacccactctattagaaattaccttcacactgatagataatggcctgtgataagaagcaagtcaaaactttttagaatgtagaactgcactgttcaatatagtagccacaagccacatatggc

SEQ ID NO: 30027 - DNA, 532 bp, Homo sapiens
gtgcctttgtagatgagaaagtgcgtaaggtcacactatatttaagtaaaagagacagagctttaacatggctttcttcattccagagttcttattttctgcattccaccatactgcattctgtgttatattagttctctgttagagccctaattatggaccattataagccttagcaaaatccagaatgatggaaataagaatatttgataatattctctaatactaaagtattgctctaggcaaaactgtaaattatttaatcaggatttctgctatttttatccaggtggtacatcatgccttacatacctctgtccttcatatattcaaatctaaataaatgctggtagtttgagtgggaggagggtggattattcatgtcaaatgattctgtgctgatgttgccacaactgtatgtgaaaataaagataattgacatggaatttgcatggagttaaggtaccttttgaaatctgcattctacaatcttttagtactgcatattaaaacattaattattcaggagccc

SEQ ID NO: 30028 - DNA, 604 bp, Homo sapiens
actggactcaattctgaaggtcgccaagaaggagagaacaatgtcttctttacccgtgccatacaaactgcctgtgtctttgtctgttggttcctgcgtgataatcaaagggacaccaatccactcttttatcaatgacccacagctgcaggtggatttctacactgacatggatgaggattcagatattgccttccgtttccgagtgcactttggcaatcatgtggtcatgaacaggcgtgagtttgggatatggatgttggaggagacaacagactacgtgccctttgaggatggcaaacaatttgagctgtgcatctacgtacattacaatgagtatgagataaaggtcaatggcatacgcatttacggctttgtccatcgaatcccgccatcatttgtgaagatggtgcaagtgtcgagagatatctccctgacctcagtgtgtgtctgcaattgagggagatgatcacactcctcattgttgaggaatccctctttctacctgaccatgggattcccagaacctgctaacagaataatccctgctcacattttcccctacactttgtcattaaaacagcacgaaaactcaaaaaaaaaa

SEQ ID NO: 30029 - DNA, 527 bp, Homo sapiens
actggactcaattctgaaggtcgccaagaaggagagaacaatgtcttctttaccccaatgacccacagctgcaggtggatttctacactgacatggatgaggattcagatattgccttccgtttccgagtgcactttggcaatcatgtggtcatgaacaggcgtgagtttgggatatggatgttggaggagacaacagactacgtgccctttgaggatggcaaacaatttgagctgtgcatctacgtacattacaatgagtatgagataaaggtcaatggcatacgcatttacggctttgtccatcgaatcccgccatcatttgtgaagatggtgcaagtgtcgagagatatctccctgacctcagtgtgtgtctgcaattgagggagatgatcacactcctcattgttgaggaatccctctttctacctgaccatgggattcccagaacctgctaacagaataatccctgctcacattttcccctacactttgtcattaaaacagcacgaaaactcaaaaaaaaaa

SEQ ID NO: 30030 - DNA, 359 bp, Homo sapiens
actttgtgacacagagtatagaacttcgctagaggaatgagtggaaacattagaaataaagtcgggtactgtctcaaataggcacaaaacgtcatctgtaaacataagtgtatctaatacgttaacttgtataactaggaattttcttggggaatgttatttgtaccaggacagagtggagaggaggccgaaaacttgtttggtggcatgctttctttctgatgcatttttcctcttgtagataaaggtcaatggcatacgcatttacggctttgtccatcgaatcccgccatcatttgtgaagatggtgcaagtgtcgagagatatctccctgacctcagtgtgtgtctgcaattgag

SEQ ID NO: 30031 - DNA, 887 bp, Homo sapiens
tgaatcaaaagtttgtctcctgtagatagcatatagttggataatttttagttcttttgattggattgtttaattcattcatttttagtgttactattgatatggctggatttgtgtctgcaattttaatttttgttttctatatgtctcgtgtttttgtggctttgcttcttcttctttgctttcttttgcattattttctagtttaacaacttaatttcttaaattatttttaactatatttttacatatttccttaatgaatgcttgatggctcacaatctccttctcagtttatcagaatctacttaagtttatactaacttatgtccagtgagatagaaacacatttcttctttatagctctaggtcctcttcacttgtttttgtgctattattgttatacttactacctctgtatatgttacaagcccaagaatactattctacttatttatataattttatgttttttaaagaacctgagactggaagtgagggaaatagggcgtgcaggaaggaaggaagaggaaggaaaagtgtgtgaaagggggctccacctcctttagtggataccctgagcttatttccaggggcctttgtaaattcccagtgacaactctttggaagatgaaatccccctcttccctgcatcttattagaacagtgtatcctggaggacatcccttgcctttcaccaagtgaccctatactggcggcagaacttctcgattttgcggatttcaaaatggctccacgtactcatagttttcatgacagacttcattgcgatagtcaaatactgttccacttactgcagttgcctacagtctgggttttgttcagttgaaattaaataaattttatgcacaaacctttaaaaaaag

SEQ ID NO: 30032 - DNA, 398 bp, Homo sapiens
gattctttaaatatgagggagaggactcgaagaaatgactgttaaactaggatttgtgaaatgacgtgggttgaagaggaggtgtggcatccctttgccattgggggccttggatggcgtccagtgacaactctttggaagatgaaatccccctcttccctgcatcttattagaacagtgtatcctggaggacatcccttgcctttcaccaagtgaccctatactggcggcagaacttctcgattttgcggatttcaaaatggctccacgtactcatagttttcatgacagacttcattgcgatagtcaaatactgttccacttactgcagttgcctacagtctgggttttgttcagttgaaattaaataaattttatgcacaaacctttaaaaaaag

SEQ ID NO: 30033 - DNA, 363 bp, Homo sapiens
tttgagacagagtttcttttttgttgcccagccttgagtgcaatggtgcaatctcggctcactgcaacttctgcctcccggattcaagcgattctctcgtcttagcctcccgagtagctgggactacaggcacgtgccaccatgcctggctaatttttgtatttttagtagagacagggtttcaccatgttggccaggctggtctcaagctcctgacctcaggtgattcacctaccttggcctcccaaactgctgggattatagcgtgagccaccacgcctggccactccatatgctactataattatttggtgcttatatgaggggaggagatgaatttttctttctttctttctttcttcc

SEQ ID NO: 30034 - DNA, 283 bp, Homo sapiens
actacacacaagtaccaaacacaatactaaatacaggtaccacacacaggtaccacagtaccacacacaagtacagcctcagtgctgtacccacacaggcactgcccacagggaccacacacagtgccaaacacaggtactgcacacaggtaccaagcacagtactgcacacaagtactgcacacagtacgaaacagtactgcacacaggtgtcatgcacagtgccaaacacagtactgcacacagtacacaaacagagtactgcacacaggtacagcctgca

SEQ ID NO: 30035 - DNA, 509 bp, Homo sapiens
tggttcatacttataaaaggaagaatatacaaataattataaaagttatcaacatttgtttaactaataatgtatttttgaactatattaagtaaaaatgaacagaaatcattaaatatgccattggccattttagtacactactctcaaggcagacaaagaatagaaacctttgccatcatactgattctgttttctaagagcattaaattagaaataaaaagtaaggtctggggcggtggctcacgcctgtaaccccagcactttgggaagccaaggcgggtggatcacaaggtcaggagttggagaccagcctggctaacatggtgaaactcatatactgaagactcatactgaagacacaaaaaataagccgtgcgtggtgccacgcaccagtaatcccagctacttgggaagctgaggctgagaatcacttgaacctggaaggcggaggttgtagtgagccgagatcgtgccattgtactccaggctgggcgacagggcgagac

SEQ ID NO: 30036 - DNA, 481 bp, Homo sapiens
acatttcagctggtcgacgtgaagaattaggagaatttaacaggcatgggcttggggaagtggcataaaggatggaggttggagtcactccatgtgtttttgaggaacataggcaattctaatttgtggggataaagtattactgggaaatggaaaacttcatttgatttctgttcaacaagcatggaagcataggctggaatgttaatgttgggctgagcagttcgttcttaatacactaggcattttaggaaacatttaagatactgaagttggaatgtgccaggattgaataagctggtggtgaagctagcagtacttaatagaagggggcaggaacacccacagaagttgcttataatattataaggaagtaggctgggccggttgctcatgcctgtaatcccaatactttttgaggcccgaggaggaaggatcacttgagggccaggagttagagaccagcctggtcaacaaagca

SEQ ID NO: 30037 - DNA, 617 bp, Homo sapiens
tctgtcagggattctgtaaaaggaattcctgtattatttaggtcagaccacacggcctctaaagtcccttctcactcaagaatctcttattctgatgaactctattcccctaccccaaatatctcatttatttcttaaaattaagtgattcaaagtaacaggggtgacaagttcacaacacagataataaaaaaaaacctacttctttgtcattttttgaaatacattgactggcttgcagtacctataaaagacattatccaaaaacctagaaatggagaactgatgataggagagaaaacagaaaaaagaaaagcacatggaaagaagagaaaggggaaaatgaggcaagatgagaatcagctgcagcaacaggggtgtgtggcattagaagtaagggctgggagccccagacactgacagagaagaaaggatggctgagatgttcccagaggccaatactggaaagcactggggcgccagctccatgtgtgtatgcagtcctccatgcggcatggctcctgctgcagggggaattccctttaccaaattaactggtgttcagagtaagaaatcacctctctacattccagtttcccaagtactttctaagggtg

SEQ ID NO: 30038 - DNA, 403 bp, Homo sapiens
aaatctgcagtcttatgaatcttcctccaataaatttgctaacaaaggaaacatttagtattactaggccgtagagactagtaatttaatctttaatttttaaatttatatgaagtaacaagagaacacaatttttcaccgcttattttataacctgattggctcccagattcacaatacctgtaggctccagactaaaaaatgccaaactgttagtggaaagtaaccttaaggcatttttcttgatatccatattagctacaatccttggcctatttctttggagtatgtttacatgttttatgaatataattacataggtgggagaagaaaaacatacaaacataatttcaaaaagatggaaataatgttaataattgcagccacaatttaaacatattgg

SEQ ID NO: 30039 - DNA, 303 bp, Homo sapiens
agcaaaaaggaaaaaaatatgtgtaagatttaaaagaaaaaaaggtgtgagtgtgtgtgcacgctgatcaaggtgctaactttttatttaggggggcatgaaaaagacctgtcatttattacttctactatttcacaagaaaggctctctcacgcatacatgcacacacacacatgcacacatgctgcagaaagcactgttaaattaattcagcaagtatgtactggcacttatgatgtgctaggcactgttctagtcattgcagaatataatagtgacaaaaaaacccaaaaattcttgccc

SEQ ID NO: 30040 - DNA, 408 bp, Homo sapiens
cacccaggcagggctccaggaggggacaggagccccaacatgaagttctcagtgcaaagctttggattctggcttggcaacttgacattttggagggcctaactttgggaaggccagtgtgtgtctggccaggtatattgatcctccaggccacctgagatgcttccaattgactggctattggtattctgtttgttcccatctgtggaaatcatgaatagcagagtatcacttttcagagttcgcaatgcctcaccctcgttcccaaccacccagatccgagagccatgcagctgaaaggcaggtgaacggccctcaagttcccaccattatcctgatgtgccctggaaagtgccaggagtccctaactgataataagacaccaaatccccactcttattaacatgt

SEQ ID NO: 30041 - DNA, 596 bp, Homo sapiens
gcaaggccgcaccgaaaggagccagtggcgggggcggggttagcgggcgtggcgctgccggggacggtcggcctagcttttcgagctgtgtacgtttgcgtaaaggctgggcggcgatagaacgtttccgtggaccagagtcgtggctgttgtctgtgttaacatttgtgtaaaataagatgcccataaaagttgacttgaacactgaggaggaagaactaaatatttaaatttcaactgacatggacacaaacaatggtcaccaagtccctaaacaggttgtgggagccccttgaggcgttcatccagcgctgtttcggagaaatctctatttcagtctactcctatacgtcagttattgaaaaacaacaatcgcaaaaacaagttgacctttttgtgttccttgagcccagtcgcaaagggccctcgtgactgggcctcatgctagacaacatgttacaaaaagatctagggtcccagaccacgccaaaaagcttcatgagacctctcctcgtctgtgcactgacgagtggccggctctggagcccaggtcgttgcttcccagtctggaggtgaatcctccatagtctggtgag

SEQ ID NO: 30042 - DNA, 596 bp, Homo sapiens
aggccagctaaaatccatgaataaattatgtgtgttctgttcacttccacgtacaacgtcttcaagctcaatgaatttataccttaaacaaacccacggagcttcaagtccacctggccccactgctccttttaaaatctaaaagctaagaaaacgagggtggttttcctttgcctgaggcctatccttgccagggcccacaggttgctctgaaaaagggggagggcgcggccgagtcccgggcatttcagagcaggggtagagctgcgcactttgtcccagccagggtgtccccgccctctctgggcaccctgaggcgggaacgccgggctccgtcctgctgagctggggcttctcttgggcagggtttccctacaaagcagcaggggctgccctcctcttcacacagagggggcagggttcccggcctcctcctctcatcaaggattcgcctcccgtaggaaaacagggggagggcggcgggggtgaggggacaaagccctgggaaggggctggatggacggggccggagccaagggggcggctggcatggccggagtatctaggggagaagcgcgatgcctgccggtccctcc

SEQ ID NO: 30043 - DNA, 472 bp, Homo sapiens
gagctgctgggcgagctgtgggctggccggacccgcgtgcctccacagggtctggagctggcagacagggagggccaggatcctggcagatggcctcgaaccacacccccggtccttgaagccacttcccaggtgatgtggaagcccgtgttgctgccagaagccctgaagctggcccctggtgtgagcatgtggaaccggagcacccaggtgttgctcagctctggtgtgcctgaacaagaggacaaagaaggtagcacctttcctcccgttgagcaacatcccatccagacaggtgccccaaagcccaggtgaccgtagcacagctaatgaagaactcagcccccaaagtgtggtcacgctcctctaagcctgctgcctccctctgatccctgagcctctggcagtagtaactggtccctccctctgctagccagaaataaacacctgagttgccttaggaactagaaaa

SEQ ID NO: 30044 - DNA, 4056 bp, Homo sapiens
cgcctcccggccggacgatggatccctgcagatcccagggctgagagcaccgcgcaccgcgccgagcccgggcagaccgagccgaggcgagcgagccagcgagccagcgcgcgcgggcgggcggacagatcggagccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctcgctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtatgagataccagacacacagatggcagatgaaaagcagctggagatactgcaggacaaagccaacttccgcagcttcaaacccaaacccttcaacatgcgtgagttctacgaccgagctgggcacgacattcgagacatgctgctctcctgccacttccggggggaggtctgcagcgctgaagacttcaaggtggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgagctgctgatgacacctgtccccttctcatgccatgggcatggcgtggctccctatcatccaaaagcagggtgctcacttctgtcccatgagggtcctccaccccagaggcccttccccaaaccctgttgtcttggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagacctggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaaccatcaaaaaaaaaaattttctacacaataatacttattattaatataacc

SEQ ID NO: 30045 - DNA, 3918 bp, Homo sapiens
cgcctcccggccggacgatggatccctgcagatcccagggctgagagcaccgcgcaccgcgccgagcccgggcagaccgagccgaggcgagcgagccagcgagccagcgcgcgcgggcgggcggacagatcggagccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctcgctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtatgagataccagacacacagatggcagatgaaaagcagctggagatactgcaggacaaagccaacttccgcagcttcaaacccaaacccttcaacatgcgtgagttctacgaccgagctgggcacgacattcgagacatgctgctctcctgccacttccggggggaggtctgcagcgctgaagacttcaaggtggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagacctggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaaccatcaaaaaaaaaaattttctacacaataatacttattattaatataacc

SEQ ID NO: 30046 - DNA, 3124 bp, Homo sapiens
cgcctcccggccggacgatggatccctgcagatcccagggctgagagcaccgcgcaccgcgccgagcccgggcagaccgagccgaggcgagcgagccagcgagccagcgcgcgcgggcgggcggacagatcggagccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctcgctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtatgagataccagacacacagatggcagatgaaaagcagctggagatactgcaggacaaagccaacttccgcagcttcaaacccaaacccttcaacatgcgtgagttctacgaccgagctgggcacgacattcgagacatgctgctctcctgccacttccggggggaggtctgcagcgctgaagacttcaaggtggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgagctgctgatgacacctgtccccttctcatgccatgggcatggcgtggctccctatcatccaaaagcagggtgctcacttctgtcccatgagggtcctccaccccagaggcccttccccaaaccctgttgtcttggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagacctggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctc

SEQ ID NO: 30047 - DNA, 3396 bp, Homo sapiens
cgcctcccggccggacgatggatccctgcagatcccagggctgagagcaccgcgcaccgcgccgagcccgggcagaccgagccgaggcgagcgagccagcgagccagcgcgcgcgggcgggcggacagatcggagccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctcgctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtatgagataccagacacacagatggcagatgaaaagcagctggagatactgcaggacaaagccaacttccgcagcttcaaacccaaacccttcaacatgcgtgagttctacgaccgagctgggcacgacattcgagacatgctgctctcctgccacttccggggggaggtctgcagcgctgaagacttcaaggtggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagacctggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctcctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaaccatcaaaaaaaaaaattttctacacaataatacttattattaatataacc

SEQ ID NO: 30048 - DNA, 2323 bp, Homo sapiens
cggaaagagaaaggggcccagagtttctctgggcagagctaggatgtgcatgtgggaaggtgctggcagaagggcaccactcaactgagacctctcacctggctgagtgcagacttcctggtggagaaggaccaggagtactgcgtgtgtgaaatgccttgcaacctgacccgctatggcaaagagctgtcctgtccccttcccccagaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagacctggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaaccatcaaaaaaaaaaattttctacacaataatacttattattaatataacc

SEQ ID NO: 30049 - DNA, 2015 bp, Homo sapiens
ctggttgaccctggagggtcctgaggaagtgagatataagagtaagaaatatccatggggaggcttggtgagaattagcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagacctggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaaccatcaaaaaaaaaaattttctacacaataatacttattattaatataacc

SEQ ID NO: 30050 - DNA, 1541 bp, Homo sapiens
atcttcactgatccattaccattcgatgttcttttattcagagcaatgtttcatgtatcctgaaactggaaactgaaccagttagtttctccatagtcaccaagcatactttcctgggatctagcccaggtctttccatgggatgcggccctggtgctgtaggctacatcctgatacctataagttcacccccaccccacagctgctggagagaaatcccaagaggcagcccttcctcaccatcccattaaagacctggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaaccatcaaaaaaaaaaattttctacacaataatacttattattaatataacc

SEQ ID NO: 30051 - DNA, 1049 bp, Homo sapiens
cgcctcccggccggacgatggatccctgcagatcccagggctgagagcaccgcgcaccgcgccgagcccgggcagaccgagccgaggcgagcgagccagcgagccagcgcgcgcgggcgggcggacagatcggagccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctcgctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtatgagataccagacacacagatggcagatgaaaagcagctggagatactgcaggacaaagccaacttccgcagcttcaaacccaaacccttcaacatgcgtgagttctacgaccgagctgggcacgacattcgagacatgctgctctcctgccacttccggggggaggtctgcagcgctgaagacttcaaggtgcttcacacgctatggaaagtgctacacgttcttggccaccacaatgggagcagccctggccgagttgtctctgtggtttctatgcagcccttcttggcgaaattcctgcgatcttatagattctaatgagctcttggaagacattgtcataaaagccagtgattttaaga

SEQ ID NO: 30052 - DNA, 592 bp, Homo sapiens
gtcattaagcacaagctgtgccgacgaggaaaatgccagaaggaggccaaaaggagcagtgcggacaagggcgtggccctcagcctggacgacgtcaaaagacacgtgagggagcgagcgagggcgccctccagcccgcctgtgcctccaccgccccaggaaccccgtccacccccgcccacccgcctctgccaccaccttctctcctttgcctcccgaatgccccagcactacctgaagcccttccgagggataacccgtccctgtcctgtccccttcccccagaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaa

SEQ ID NO: 30053 - DNA, 564 bp, Homo sapiens
agggccatgggaggctggtcctggggtggggtattgaggggtccagatggagtggtgggcaatcagtaatgggaaggacaggtgagcaaggacctgggtggtaatctggctagtcagaagcatgagtgatcgaatgaacaagaatgctctgtaaactctgagacctttggaggctgcagagggagaggggagcagaactccagagatctgcatcttgtcagaggagtccatcaagctgatttggggagaagtccccgcactcccccagctccccggctctcccagcagctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggtcaggcctggggctccgagcatactcctggggtccctgggcctttgctgcccttcactagctccccatccatatcaatctcccaaccccagttccagcccaccccatcccacacccac

SEQ ID NO: 30054 - DNA, 3339 bp, Homo sapiens
agtgagcagtactaggaaatcgttatcacttctaggctgaagaagcacaaaagaagacagtgctctgtagggagccctggcaggatctgtaatcatggagggcctaaggcactactagagctacagaggggcgagggctggggaaggattcataccccaatctttcctcctgccttctgagccattaccaatacctcccaactgtcaaccccaactagaagcccatgcaggtggcaaaggagctcaggcgatgcaccctaccaggaacagttttccagggcacacagagggcaagaaagggtcttcacacgctatggaaagtgctacacgttcaactcgggccgagatgggcggccgcggctgaagaccatgaagggtgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagacctggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaaccatcaaaaaaaaaaattttctacacaataatacttattattaatataacc

SEQ ID NO: 30055 - DNA, 2613 bp, Homo sapiens
cgcctcccggccggacgatggatccctgcagatcccagggctgagagcaccgcgcaccgcgccgagcccgggcagaccgagccgaggcgagcgagccagcgagccagcgcgcgcgggcgggcggacagatcggagccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctcgctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgtgaaccaaaggcctagatggggaggactaggagagcgagggggcccccagctgcctcctcacatctgccctggggactccccacactccggggcagatctttcctcttgtctgtggtaaggaaggagtcttgaccatagagtcctctctctgcctctatcccattctttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagacctggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttcgcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaaccatcaaaaaaaaaaattttctacacaataatacttattattaatataacc

SEQ ID NO: 30056 - DNA, 438 bp, Homo sapiens
ctggtgctggacattttctttgaagtcctcaactatgagaccattgaacagaagaaggcctatgagattgcagggctcctgggtgagctgctgatgacacctgtccccttctcatgccatgggcatggcgtggctccctatcatccaaaagcagggtgctcacttctgtcccatgagggtcctccaccccagaggcccttccccaaaccctgttgtcttggtaagtggtgagggaagggaactgagccttctcttagggcaaagtggaaaagagaaaagacaggcctgtgggcatgagggaggggtaggcatggaagtggagactatttcatatgcccctaaactaagagggttgtggtattttgtaaacgattatttttcttgaaaaacacctgcttgttttagaaaggtagaaaaacgcagaaaagcatagagaag

SEQ ID NO: 30057 - DNA, 1867 bp, Homo sapiens
gtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgt

SEQ ID NO: 30058 - DNA, 1458 bp, Homo sapiens
cactaagggaatcactggttttttggtttttgtttcttttttttttggagatggagtctcgctctgtcacccaggctggaggagtgtagtggcgcgatcttggctcactacaagctccgccccccaggttcacaccattctcccgcctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgt

SEQ ID NO: 30059 - DNA, 1083 bp, Homo sapiens
  misc_feature (17)..(17): n is a, c, g, or t
  misc_feature (241)..(241): n is a, c, g, or t
atgagcatccaaaagangtatctggagggagattttgtctttcctgtgagcagcagcagcttcctacggaccctgctggagccccagctcggatcagcccttctgacagcaatgaatgcttcgtgctgcctgccctctgttcagccaacactgcctaatggctcggagcacctccaagcccctttcttcagcaaccagagcagcagcgccttctgtgagcaggtcttcatcaagcccgagnttttcctgtctctgggcatcgtcagtctgctggaaaacatcctggttatcctggccgtggtcaggaacggcaacctgcactccccgatgtacttctttctctgcagcctggcggtggccgacatgctggtaagtgtgtccaatgccctggagaccatcatgatcgccatcgtccacagcgactacctgaccttcgaggaccagtttatccagcacatggacaacatcttcgactccatgatctgcatctccctggtggcctccatctgcaacctcctggccatcgccgtcgacaggtacgtcaccatcttttacgcgctccgctaccacagcatcatgaccgtgaggaaggccctcaccttgatcgtggccatctgggtctgctgcggcgtctgtggcgtggtgttcatcgtctactcggagagcaaaatggtcattgtgtgcctcatcaccatgttcttcgccatgatgctcctcatgggcaccctctacgtgcacatgttcctctttgcgcggctgcacgtcaagcgcatagcagcactgccacctgccgacggggtggccccacagcaacactcatgcatgaagggggcagtcaccatcaccattctcctgggcgtgttcatcttctgctgggcccccttcttcctccacctggtcctcatcatcacctgccccaccaacccctactgcatctgctacactgcccacttcaacacctacctggtcctcatcatgtgcaactccgtcatcgacccactcatctacgctttccggagcctggaattgcgcaacacctttagggagattctctgtggctgcaacggcatgaacttgggatag

SEQ ID NO: 30060 - DNA, 294 bp, Homo sapiens
taaggatactttataactgaaagggatgactttagtttggtaaaatttgaagcaaaagagaagctgaggcaccaatcataccctatacagacagctaagcacattgtgtaaggcagatgttgcccaccactcagcccattagagagctcatgcaccatcaaagccagaataaagcaataagcccaatggtgatccaaccctttgctggtgttaattttttttttttttagacagcgtcttgctctgtcgccaggtgggagtgcagtggtacaatctcagctcactgcaacctcc

SEQ ID NO: 30061 - DNA, 137 bp, Homo sapiens
ccatctcatccccaaaagtacaaaaactaaataaacaaaacaaaaacaaaaccatactactattattatgaggcctgagataatttttaaggttgcctgaaacaacataaaacctcccctcatgggccaggcgcggt

SEQ ID NO: 30062 - DNA, 933 bp, Homo sapiens
  misc_feature (833)..(833): n is a, c, g, or t
  misc_feature (843)..(843): n is a, c, g, or t
  misc_feature (856)..(856): n is a, c, g, or t
  misc_feature (858)..(858): n is a, c, g, or t
  misc_feature (900)..(900): n is a, c, g, or t
aagagaccatatttgttcgcagaggaagccgttgctttctgggatctggctacgccagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggctggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactnccccacccanaccaaccacgaananccagcagaagcagaaccacaaacggcaaaccccctgctcccncaaaagacagagcacgaaaccccccagaacgtc

SEQ ID NO: 30063 - DNA, 906 bp, Homo sapiens
  misc_feature (24)..(24): n is a, c, g, or t
  misc_feature (51)..(51): n is a, c, g, or t
  misc_feature (806)..(806): n is a, c, g, or t
  misc_feature (816)..(816): n is a, c, g, or t
  misc_feature (829)..(829): n is a, c, g, or t
  misc_feature (831)..(831): n is a, c, g, or t
  misc_feature (873)..(873): n is a, c, g, or t
atgccttattaagggctgaacacnttaatttagaaacccaacgcttgtggnttgtaaaactaaagcgtgtacgtcgatcggaggatgaagcaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggctggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactnccccacccanaccaaccacgaananccagcagaagcagaaccacaaacggcaaaccccctgctcccncaaaagacagagcacgaaaccccccagaacgtc

SEQ ID NO: 30064 - DNA, 303 bp, Homo sapiens
aaacacacagcctccttcactggcaacactccacacgagagtagtcgattttttacaattgatgaacctacatcgacacatcattggctggatgtggtggctcacgcctgtaatcccagcactttgggaggctaaggtgggtggatcacctcaggtcaggagttcgagaccagcctgtccaacatggcaaaacctcgtctctactaaaaatacaaatattagccaagtgtgatggcaggcacctgtaattccaattacttgggaggtgagagaattgcttgaacctgggaggcagaggttgca

SEQ ID NO: 30065 - DNA, 293 bp, Homo sapiens
gagagctcaaaagaaagcatcaaaaatgaagcacagaaaacaacaaacagaaaatgcagatgaggctcagaaacagagacaggttgagaaatacaaatactactgtgttatagttgcctacagtattcagtacagaaacatgctgcacgggttttcagcctaggagcaacaggttataccgtatagcctaggtgtgtagtagactccactgtctcgctctacaatgtttgcacagcaacgaaatcacctaatgacacatttcttagaatgtttccctgtcattaagtaacaca

SEQ ID NO: 30066 - DNA, 889 bp, Homo sapiens
gggattacaggtgtgagccaccgtgcccagccatgagcggtcttgaaaatgaaaaatggtcttggcccacagaaaccaggtatgagggagtggttggaatggtataaagtcatcactgttagggaaacagtaactttaaatgcattttaacagtgggtctttaaaaatgaatgtcatttggttaaagagttttgctgggcattgagataatctgacagcatctccacttcctgttttttttcttaatctccactttttttttttctatgatgagcgcccctaaaatgctggtaagcttctttccaacaaaattgcggtcaaagtaggatgctggggaatgctgattttagcaaaagcttgtagaaaagagtggcctggcacatgagcttaaaaaaaagaaaaaaagctggctcttgaattttggcacagtgcaacctgttccataccagacaaatgaacaggcttaatctggtaccaattctttttctctcttactcctcagaagtgaagggactgcagatcttgttgttttggggacactttcatggaactgtatgtaggtttttttgaatggtgagaaatctgaataattggtaaggggaagggaatccctcatttcagcttttcttgatgttgttactaataactatgaaaaaacttctgagagaacaatgtgaactgaagatgactcagcagttaagacaatgctaagttctgaaaccacaggtaaatgaagggctaattaatgtgtggtatacttggacaaaatgaagtactcatttgcactggattactgtgtaatgataacgaacactgttcaagaacgatttatatttccataagatttgtactaaattttataaaagtaaaacaactttttataaaccca

SEQ ID NO: 30067 - DNA, 400 bp, Homo sapiens
acccgggaggcggaggttgcagtgagccgagatcacaccattgcactctggcctgggcaacaagagctctgtctcaaaaaaaaaaaaaaaaaaaaaaaaaaaagaaatgtacttcttggattccactccagacccagagaatcagaaactgcaggataaggcccagctctctcctggtgattctgatgttcacccaggtgggagaaccactgctccagaccctgtatttcaatgagtgaacggcactatacaaaaagcatagaaacgtcttcattctcaacctagcttcatgtccttctctggaaaatggaatgataccaccttaccagctggattgtaactgtctgttggtcagatacagtattttgatgatttcagtcaataactctgcaagccttgg

SEQ ID NO: 30068 - DNA, 513 bp, Homo sapiens
atctgttgacacgtcgacccttcttccacaagaccagaagctcatatccaatctaatgtcacttacccttctgagaatctgatgaaaatggcgtgccttatgtgcctagatgcttttgcacacagtctaaggtgacttatggactccaggtccagcagccacacccagtcctgggtctccgcacagggagggacccgtctcacacacctgtctcacgttctagcatgggcctgctcagcggtctcaggctgtgagtaaatgggatgtgagcttggatcgccccacactgttgcccccgggggctggccagctgccacttgaatgcctcctctgccaggaagctcactgcattcagtggctatccacgagttcagcttaggcagttttcactgatccctttggcactgtttagccagtgataacccactctgggaaatgtgttttgcatcatttcccggtccctggcaagtgtctagtcatcctggggtgatttttaccttctgtgggagagct

SEQ ID NO: 30069 - DNA, 455 bp, Homo sapiens
atgttcatatgtttttcaagaaatattgattgactagtatgtgttttgcggatatagcagtgaacaggatagacaaaggctttgcattcatagagtttatttgtacagtagtgtcacaggcaaactataaccaaatgaagaagtgaataaggaatacattatcaattccttttatgaagaaaatacaccggctgttgagagtgagaataagtgagggttactttagaccagccactttagaaaggctggttaggagcctggccagtgtggtgaaaccctgtctctaccaaaaaatataaaaatgagccaggcatggtggcacctgcttgtaatcccagctactcgggaggctgaggcatgagaatcacttgaaccagagaggcagaggttgcagcagtgagccaagatcccaccactgcactccagcctgagcaacagagtgagaccctgtctga

SEQ ID NO: 30070 - DNA, 346 bp, Homo sapiens
gcccaagcccatctctgccattttcagtgacagctggctggccaatgagcctgagcactgggaatgcccagcagcgacatctagggggctgctttatatttggagctagcaggtctcttttctagggctttccaggaaagatttagaattaaacattggatggattttgtgtgttcatttctttttccatcactgtgcctttattttcttggggctttcattaaaagcagaaaaacagataatggtagaaacatctatagcatgcatacaaagaagtaaaagatttttataattttttgccttaaaatatatctaatgctgtggcctctgagccattctcagttgg

SEQ ID NO: 30071 - DNA, 436 bp, Homo sapiens
gctgatgcattctgtgagttagaagaaaacttccaaagagccattttttccaccctgtctactgtataaaattgcttctcaaacatgtgctgcattgcagaggattaccattgttttgctaaccagcgtctggtctttcttatgtggcgctgcaattactagtgtcaaaccctgttggtaatacccagaggacagtgtctgaagtccttattcagtattcacatttggccgggtgtggtggctcacacctgtaatcccagcactttgggaagcagaggcaggtggatcacttgaggtcaggagttcaagaccagcctggccaacatggtgaaaccccatctctactaaaaatacaaaaattagccgggcgtggtgtcaggtgcctgtaatctcagctacttgggaggctgagacaggagaatcacttgaacccagg

SEQ ID NO: 30072 - DNA, 253 bp, Homo sapiens
gactttggcttcagtacaacattcagagaggggcagatgctgacagctttttgtggcatgtacccctacgtggccccagaacgctccctgggccaggcatgccagtgacccgccagggacatacaaagcctcagtgtcatactgtatttcaggaatacagtaggtagaagggccaggactttgcccttttactcagggaagcctccaaacttcaagaaaaaattctcacaggaagataccatgccccaccact

SEQ ID NO: 30073 - DNA, 1008 bp, Homo sapiens
catgttgtatcatgtgccagaagttccttcctttgtatgactgaatatattcctattgtgtgtgtgtttgtggttgtttgtatgtacatactttgcttatccattcatctgccaatggacactaaaagctcccaccttttatgtatttatttataacctaggaagtgaagaagcttctgccaaattctaaattttatggaggaaaacaaatcatggctgattagataactagtgtttactttagatagaatattaattttaggtctactttatggcatatagaatttttttaaatcaatatttgcattatatttatgcccattttatagggttgggataatttacttatttattttactttattttattttatttattttattttgagatggaatcttgctctgtcacccaggctagagtgcagtggtacagtctcggctcactgcaacctccgcctcccaggttcaagtgattttcctttctcagcttcctgagtatctgggattacagacatgtgctgccacacccagctaatttttgtatttttagtagagatggggttttgccatgttagccaggctggtcttgaactcaagtgatccgcctgcctcagcctcctaaagtgttgggattacaggcatgaaccaccacgtctggcctgtaattttaatctagtgatttatagttgtatctttacatttataacattagtgttatatttgtgtcatacctatgatttatttgattttctaacccaggggtcaggaagctatggcctattgttcaacctgcctgtttttctatgtctttcaagttaagaatagattttacaggtgaacatttgtacccaatttcattatggggtactaactttgaatctcaattaagcaaacgcccaagaaaaaaaaagtttattcttctcattaattatacattacaaaaaattatactcagttatttttatgacattttgaatttcctcaatgcaaaaaatgtgactctgaaatg

SEQ ID NO: 30074 - DNA, 418 bp, Homo sapiens
ggataaccagagaactcgagggacaagtaatcttttaaaaaagcaaagacacataaagatgcacataaaagaatgtttatcacaacatggtttctaatagtagaagatgtatacaacttaaatgtctaagaataaaggaacattttaataagttatagtatataattatagtggaataccgtgcagccattcaaagcgaggtggtagatgctggtgtggtggtgtgtgcccatagctggactatagtgccagctactctggaggctgaggtgggaggattgcttgagcccaggagtttgagaccagcctgggcaacagagccagaccctattgcttaaaaaaaagatgtgatagaaatgaatttatacaaatggggccaggtgtggtggctcacgtctatagtttcagcactttggga

SEQ ID NO: 30075 - DNA, 634 bp, Homo sapiens
gccaagccacgtgtgcaagcctaattgcacggaagccctcaactcctaactccaggccttccctgcctatcctattcccatttgaaaaggggcagagtgagtttagaatcacatgttgccaggcactctcagatactgttggtggaactgtaacttaactgtaacatttctaaaagcattttggtgataagtgtcaagaatcctgatatttttatgcccctttgactcagtaattccacacttctgtaattctccaaagcagttaatgtgaaatatagtaaagcgttatatgtcacagaaaatagttttctagaaaaaaacaaactatctaaataaacaagtgttaaagtaaatgttggtaccggtacaacatgggatattgttttgctgttaaaaatgttcacaatgtttggccgggtgtggtggctcacgcctgtaatcccagcactttgggaggtcgaggcaggcggatcacctgaagtcaggaattcgagaccagcctggccaacatgctgaaaccccgtctctactaaaaatacaaaaattagccgggtgtggtggtgtatgcctgtagtcccagctactcaggaggctgaggtaggagaatcacttgaacctgggaggtggaggttgc

SEQ ID NO: 30076 - DNA, 559 bp, Homo sapiens
gggaccttccccccacccccaatgccacgaacaaaaagggaactaaaagccagagcagcaagtgtgtgagcttatatcccaggaactctggagatgttactggaccctaaaataatggttgggtgcttgagtattaatacagagactggatatgagacttgggtagatgtgaggtggggatcaagcctttgcagaactgcaatttcagtgaaactgggactcaaacaattgcatccaccagaacaggaaaaaaggaagctggtctccatgtgggactcccatgagagattagaattccaggctttccccttataaagggatctgaatttaccctatcagtgtgatgcaggaaatcctaagctgaaaaaaacataaagattggtctcaggttgctggaacccctggagcaacaagcacaatttctctagagggacagtttcaccaccaaggccaaaagaggtttttttttttttttttaaataaacaaaactctgaagttcttttcttttcaagtttcagttaaaattataacataagaaaattataagtgagatgcaat

SEQ ID NO: 30077 - DNA, 2125 bp, Homo sapiens
gtgttgtcaacaacggtgaatgtggatggacacgtcctggctgtttctgacaacatgtttgttcataacaactccaagcatggacggagagcaagaagactcgatccatcggaagctaccccctgcatcaaagccattagcccgagtgaaggctggaccacaggaggagccatggtcatcatcatcggggacaacttctttgatggtctccaagtggtgtttgggactatgcttgtatggagcgagctaataacccctcatgccatcagagtacagactcctccccggcacatcccaggcgtggtagaggtgacattatcttataaatctaaacagttctgcaaaggagccccaggaaggttcatttacacagcattaaatgaacccaccatagactatggcttccagagactgcagaaggtcatccctaggcatcctggagatcctgagagattagctaaggagatgctgttgaaaagagctgcagatctagtggaagctctttatggcacaccacacaataaccaggacatcattttgaagcgagccgcagacattgctgaagctctctacagcgtccccaggaatcccagccagcttccagccctctctagctccccagcgcacagtggcatgatgggaatcaactcctatggcagccagcttggggtcagcatctcagagtcaacacaaggaaataatcaagggtacatccgcaacacaagcagcatctctccgcggggatactcttccagctccacgcctcaacagtctaattacagtacctccagcaacagtatgaatggctacagcaatgtccccatggccaacttgggtgttccaggttcaccaggatttctaaatggctcacccaccggctctccttatggaatcatgtcattaagtcccaccgttgggtcttccagcacatcctccatcctcccattttcctcttcagtttttcctgctgtcaaacagaagagtgcctttgcccctgtcatcaggccccaaggctccccttcacctgcctgctccagcggcaatggaaatggattcagagccatgaccggacttgttgtacccccgatgtaaagaagaactgctttcttatagcacaaaactacttactctgatggaccaataatgaagaaagcactaggagctcttttgggggtgtagtggtgcccccacatgaacatgatggacacccttgggtctgcaaggagccagcatcttacttggtcccacgtcctcctatagctctgatggtggctacacaaactgaccctcttgggacaaggacaaaagatgtcattgacgtagtcagtgctaagagcagaaatgcaattctttgttatgaacattatgaaaaccaccttcctatgtttgtaaaatatttaagaaaaaattggcaaacaattaatgcttaatattttggatactatttgtttttctttgtaggaaaaaaaagttgaaagtttctattttctatgaagcctttcagataccaatttagtttatgcagaaaaaaattgaacaaaacagggtaccagcacggaagactttcttaaaacgcaacctgaattgaatgatgaaatgttgtatgtgtgtttgcttatagcttaatctctttaaaaaatgaacaaaaaaagggaaaaattttaaaatgttttacaattatttaaataaataaatgtgtaacttattgtaagtagaggtagaaattaagacctttttttggaagagagagggatttctcttcctgatgtaaaatgaaaatgatgcaaacatgtagtaacaagttttaaaggtgtgtgattattactgcagttacttactagattcttatcccctgtcctgcaccccctccttttccatcactttattgacccaagggcaagaacatgtagattcccacagaacaccctaatgcagaaacagacactctagcacatgcacaaatactccaacccatcaattcattcccagctccgtctgatttctaaatagtccacactcttgtgaatactttttaaaattcctattattagctttcaacgttctcccctgagcagtccagagaattcccatgtttgagtctgtctcaggctttcagcatcccaag

SEQ ID NO: 30078 - DNA, 859 bp, Homo sapiens
gtgttgtcaacaacggtgaatgtggatggacacgtcctggctgtttctgacaacatgtttgttcataacaactccaagcatggacggagagcaagaagactcgatccatcggaaggtagggctgcctgcgctcagcatagcagacacatgaaattctccacgaatttccttgttcgaacttcaaatttatgtcttggagtcagagcagagaaagtacacagaacaatgtgggtttttttttttttaaacgaagttgtaaacacagactccagcctgctccactgtaaggcccacacgtctaccagcccgtgccaagtcctcatgcctcccactctcttccatcctgttctgtgttttcctttttgtgagacgggcatttcaggcaaacataggcctatgacatcttagttaaacaggaacattgcagtgccagacatgtatgaataagtgtcacatgtgcccttaaacagattgtaggcaaaacaaaacaatgctcagaatgaaactgacactaattgatttttgtttgcttggacaagaagaaatcatggtctgttctgggtagttttccaagtgcattaaagtaattagaaataccggtaactgttaaatttcaagttgtccaaaaaattaaagtatatcgatgaagataactgacaaatctaagtaaattccattttaattattccccttctgtctgcactccccaactcactggtatagaaagaccttataatacagaatgttggtcaaactaggctactattttagtgtgatgttttgttatatactaccacccaacccccacctcccaccctaactcagccctgaaaatgtatcttgtatcattgtaaacagg

SEQ ID NO: 30079 - DNA, 1127 bp, Homo sapiens
ggcacgagaatggggaaaatggggaattctttcgatatagaagggtgtggaaaagagcagagagaacagatctcccctttcccatcttagatctccatttttatgttcctgttgtcgagtggtttgtcatggtaaagaaaaaatgcttttaaatgtgagtgtatatatatcatctatatgttgcaaaatgtcctccttcgtgattcagcaacctgatcttacttcagtgctactccttcctgtgtaattaagcctcagctccagctctctgtattgcactcactagtcatcaggttggaaggtcctgggttcctgtgtcctgttgggcaaccgcatgatagaactttaatgctacttcctggcatagcaggagatgaaagagcagggggaagaaacatcaatctaaccacgaattttatttccttgtgtttctgatgctaaaaatggagaggaagtcaaactagacaagagggaagtctccatgaagtgtggaaaacaagctccttgattgtggatgtgcagagctgcctgttgagtctgaggagtctggcatgtgacacactgcagacctgagacaagaagccttgttgctatgggtgacttttagtgacctataaattttgcaggcgcgccacggcactctattattgctttctttctctgagtcactaattagatcctgatgatttccatgtgaaaccatgaggactgggagatgcaaaatggttttgctgtgtagattcatgaatgctggactgttggaggatatctgagtgtgctttgcatacttggcttaatttgtttttttttaactaaaagtagttgtaggtgaaatgattacttaggtaattgttttggtaaatggcttgaagttgaaccacagcagttttgctatttggaaaaaaaatgaaaaaaataccattctaatttcagtttatttggtttactgacccagttttggctaggggttattgaatctagtgagaattattttaagcaccccccaaagaaggaaagatatgaagtcaagagaaggataattatattgtaaaaataaaaatttaatgatgtttaatttttcaaaattgtaatttttattaaaaagtaattcagtaattaaaaaaaaa

SEQ ID NO: 30080 - DNA, 585 bp, Homo sapiens
tctaaataagtataaccaattacatggtatgatgacccttacttgtgacactagtgtctccctagaatagctttttgtctgtggatagagccaaagatgctagataaagttcaaattagggaaaataataaactcattcataaatcagaatcaaacttgtctctctgtgctaggttaagcattgctaatttaaataaaatctgcattaattgaaatatgctgaaaattttaagatatatttgcatttattatgatgcattttgcatcagagatattctattcttgatcaatatttctcaaatattggccaggcgcagtgactcatgcctgtaatcctagcactttgggaggccgaggcaggtggctcacttgaggtcaggagtttgaggccagcgtggccaacatggcgaaaccccatctctactaaaaatccaaaaattagccggatgtggtgatgcatgcctgtaatcccagctacttgggaggttgaggcaggagaatcccttgaacctgggaggcggagcagtgagccaagatcacatcactgcactccagcttgggcaaaggagtgagactccatctcaa

SEQ ID NO: 30081 - DNA, 135 bp, Homo sapiens
gaaccatgaattaagcaaagggttaaatttgatggactttggttgacactggtagaggtacaataacaagactatgtacatactaagcagatgttcttaaactttgatgtgaatcagaatcatctgagaaactta

SEQ ID NO: 30082 - DNA, 192 bp, Homo sapiens
agcgcacttgagacagaggtaatgatggggacgaagtgagaacagagacccagaaggagaatcaatggaccatatttgtaagagctttgaaagccagcctgagaattggaggatttattcataagaaagtgtagagaccctgtgtatttcagagctggatactgccattaccacagatgaaagttgcaatga

SEQ ID NO: 30083 - DNA, 428 bp, Homo sapiens
ctgggttacaggcgtgagccaccacacctggccgcaactccctttctgagtcaagttttccattgttgtaatgacaattgttatacccacctcaaagagccctgcttaagattcctttccttgactcctgcttggcatctggacaatggggcccatagcaagttctctgcagtgactgtttgcagtttccacagtgcctagcccagagctgagctgcaagtaggacaatattaaaggtcattggttaatatagagccaactgtgcagaagtagaggcagctatgatgtaacagaaaaaggccttggcttggagtcagaattcctgggttacaatgtcagttctgttcactgtgaggcccttggatgagtcactaaccctccctgagccttttctttatctgttaatattaaaaatatgattaataata

SEQ ID NO: 30084 - DNA, 244 bp, Homo sapiens
gcatttaagtagcacaggaaaatcatagaaattggtctgtttcatggccacagagatgggaaccataaagactggagattccaaaagagagaagaaacaagaaggagaccaagggtagaaaaactacctattgggtgctacgttcactacttaggcaacatgatcattagaagcccaaaccacagcatcatgcaatatacctctggtacaaacctgcacatctattcccctgaatctaaaattg

SEQ ID NO: 30085 - DNA, 441 bp, Homo sapiens
ttcactagacctagagattttctgattatataaatcagataattcttagtagactgcccgtctagtttgtcctagggccactatgaatagtgagccaatagcaaaggtctctgtatgctacgacgttccgcttgctgctccattatgaccattacggcaactgtgcccaccttgctcctggataagagctgccacctggttctgcccctccaggaacccatcatccattaaaatcaagaagtcttttaatgaagaggtcttctctcagtggggtctcttaagaagccccaacaagacagttggcttgaaacatgtgccaactctggagaaacctgaccacattaatgccaatcaagaaagagcttttctgctcttaccactctatctccctacattccctacatcctggaagggccagaaactgtggcgtgcctgagtttc

SEQ ID NO: 30086 - DNA, 948 bp, Homo sapiens
tacacatagaagtgagtttattagggagaactggctcacatgattacgagcagaaatcccacaacaggctcttggcaagctggggaaagacagaagcccgtagtgtgactcagtccaagtctaaaagcctcaaaaccagagaagccgactgcgtaggtctcggtcttaggatgaagccctgtaatcctccaggaggccgctggtgcaagtcccagagtccaaaggccaaagaccaggaagtctgatgtccaagggcaggaggagaggaaggaagcatccagcacgggaagacagagagagtgatgagcaagctgctcacccttttctcttctgcttgctttgttctggcctcactggcagctgatgggatggtactgcccacattcagggtgtgtcttcttctcttagttcacggacccaaatgtcaatctcctttgacaacaccctcacagacacgcccagaaacaatcctttaccagccatctaggcattcctccgtctagtgatgttcacacctcatattaaccatcacaatacactttgtgtatagccagaaggtggtctaggcagcaatagatgtaatgttttaattacatacattaattgtaatgtgaactcttggtaactcttatttttattgaagaatctaggaggtaaacagttttaattatgcaccagatgcgtatcccaggatgaagggcaatgcctggggttagtccaaaggcttgattctcaagacacataggtttacagatgagataagcaagctttaaaagtattacagaagcaaacttttttatcctaatacatctagcagacaatagtatctgacctgcttgactaattcagcccagatatctaaattaagttttgaagacatttctattttaccaataatttttaaactgtctctagcaaagattattaaagtcacatgaagtgaatgct

SEQ ID NO: 30087 - DNA, 1836 bp, Homo sapiens
aggatggcggagagggctgagggcgggtcgcttccggcggcttttcccgcagctcctgcgtaaaggagcatgagagcgtgggagttttgcagtggccgtggcgttcttcgtcgcgtctcggtcgggcgtcgctttctgcagctcctgtcagggagcgcgaggcctgttattaaccgcggagcgctttgtcacgaagtccctgtggcgtcttgaagaaggcattccccacccgccaaatggcgtccatgcccccgacgcccgaggcccagggaccaatactctttgaggatctggctgtgtatttttctcaagaggagtgcgtgactctgcaccctgcccagaggtccctcagcaaagatggtacaaaagagtctttggaggatgcggctttgatgggagaggaaggcaagcctgagattaatcagcagttaagcctagagtctatggaacttgacgagcttgccttagaaaagtaccccattgctgcaccccttgtcccttacccagaaaaatcctctgaggatggagttggaaaccctgaagcgaaaatattaagtggaactcccacttacaagagaagggtcatcagccttttagttaccattgaaaaccacaccccattagtagaactctctgaatatttaggaaccaacacactttctgaaattcttgattctccctgggaaggagccaaaaatgtgtacaaatgtcctgagtgtgaccaaaacttcagcgatcattcatacctagttttgcatcagaaaattcattcaggagagaaaaaacataaatgtggtgactgtggaaagatcttcaatcatagagccaacctgaggacacacaggagaatccatactggtgagaaaccttataagtgtgccaagtgcagtgccagctttcgccagcactctcatctatcccgacacatgaatagccacgtaaaggagaagccctatacatgtagcatatgtggtagaggttttatgtggctcccaggattggcacagcatcagaaaagccacagtgctgaaaacacctacgaatctactaactgtgataaacattttaatgagaaaccaaatcttgctttgcctgaggaaacattcgtatcaggcccccagtaccagcacactaagtgcatgaagagcttcaggcagtccttatatcctgccctttccgagaagagccacgacgaggactctgaacgctgcagcgatgatggggacaatttcttctcattctcaaaattcaagcccttacagtgtcctgactgtgacatgacctttccttgtttctctgagcttatttcccatcagaacattcatacagaggaaaggccccataagtgcaaaacatgcgaggaaagttttgctttggactcagaacttgcatgccaccagaagagccacatgctagcggaaccttttaaatgtaccgtgtgtgggaaaactttcaagtcgaatttgcatctcattactcataagcgaactcacataaaaaacaccacgtaaagtaaatataacaaattgttattagtgattgggcttttcagtatctgtatggtgggaagcagttactgtatatgtcccaggcaatgtgctaagcactttacacacattcccatgtaatacttaattctcagcacaaccttgatttaggcagtatcatttccattttataagtagggatgcaaaatccgtgtcactaaactagtgaatgaacccaggatttgaactcagttactgtacaactgtgagccagaagaagatacacaacttttgtttaaattcaattttcattaaaatgaaggctcttgctaaagttattttaattttg

SEQ ID NO: 30088 - DNA, 239 bp, Homo sapiens
tcctgtcagggagcgcgaggcctgttattaaccgcggagcggtaagtgggcccctttcgaggccgggccaagaggaggagcagtcggcgtaggtttttaggggggggttcggggggaatcgagggaggctaggggtagtggaggaacttggcagcggaatgggtccctttaagaactgttctctccccccgcagctttgtcacgaagtccctgtggcgtcttgaagaaggcattcccca

SEQ ID NO: 30089 - DNA, 405 bp, Homo sapiens
gaggctgggaggcatcctggggaggggaggtcacgttggatcggggtttccaggcgagatttggaaaagcaaggggagggtgagcccagtggagggctaaacctggccgaaagcccagagataagaaagagctcagccttggtttcaagcaccaacggcctaaaaaggaaacccagttatttaacagaatccattctcttttaaggctcagtgtgtatctgagacaggaccatttcccctctccagtgcaagcttcttcatggactttgttcagatttcaattttataatagctttttctattctcctcgtcagtatactttttttttgttccaactgataaattattcttgctacttagttttaaaaacattattcaagagtattgccttattaaaataacttg

SEQ ID NO: 30090 - DNA, 496 bp, Homo sapiens
aaaaatgcgtgtatacgtacccctacgtgtggaaaactggctaccgcatgcttaacaaaataacttgggaatgaattactcatggtgaggcttccgatcagtgtctaaccctggtagcgtctgccagtagccacaccgaaagggtctaccaagggtacactatggacatttttcatttaaaggtgaaagattttttaaaatgcattgctaagaaacatccctggccgggcgtggtggcgcacacctgtaattccagcactttgggaggctgaggcaggtggatcacttgaggtcaggagtttgagaccagcctggccaatgtggtaaaacctcgtttctactaaaaacacaaaaattagtcgggcgtagtggggcacgcctgtaatcccagctactcgggtggctgaggcaggagaatcacttgaactcagaaggtgaagattgtagtgagctgagatcacgccactgcactccagcctgggcaacagagtgagac

SEQ ID NO: 30091 - DNA, 481 bp, Homo sapiens
tctcagatggtttaggtgccagtggcttccgaataaaacagcattcttgaagtgaacagctgatgaggacatgaaatattatgccaaagctggcatcacactgttctttttcctggatgaaaatctctctgagaagcatttgctcttaactttggtgtcctggggactgctgccttatcccaggaagccacccagagtcttggatgtgtgggatccttaggacttcatggtaaacctgctctagtccctcgggttagtaaaatgaagcccaggacatctgagagcccccagcacttccatagaaatggaccaaaatcccttctcccagggggagaaacctggaataagctcaagaggacagacggctaaattttcaagaatcgtgtgagctgctgttaaacaagccattattaaaactttaattgtgtaaacttacaattaggtcagttatattaaaagtaaaagtgatacataccccaaa

SEQ ID NO: 30092 - DNA, 1308 bp, Homo sapiens
  misc_feature (102)..(102): n is a, c, g, or t
  misc_feature (123)..(123): n is a, c, g, or t
  misc_feature (309)..(309): n is a, c, g, or t
  misc_feature (429)..(429): n is a, c, g, or t
  misc_feature (642)..(642): n is a, c, g, or t
  misc_feature (666)..(666): n is a, c, g, or t
  misc_feature (807)..(807): n is a, c, g, or t
  misc_feature (895)..(895): n is a, c, g, or t
atgggcgactggagctttctgggaagactcttagaaaatgcacaggagcactccacggtcatcggcaaggtttggctgaccgtgctgttcatcttccgcatnttggtgctgggggccgcggcngaggacgtgtggggcgatgagcagtcagacttcacctgcaacacccagcagccgggctgcgagaacgtctgctacgacagggccttccccatctcccacatccgcttctgggcgctgcagatcatcttcgtgtccacgcccaccctcatctacctgggccacgtgctgcacatcgtgcgcatggangagaagaagaaagagagggaggaggaggagcagctgaagagagagagccccagccccaaggagccaccgcaggacaatccctcgtcgcgggacgaccgcggcagggtgcgcatggccggngcgctgctgcggacctacgtcttcaacatcatcttcaagacgctgttcgaggtgggcttcatcgccggccagtactttctgtacggcttcgagctgaagccgctctaccgctgcgaccgctggccctgccccaacacggtggactgcttcatctccaggcccacggagaagaccatcttcatcatcttcatgctggcggtggcctgcgcgtcnctgctgctcaacatgctggagatntaccacctgggctggaagaagctcaagcagggcgtgaccagccgcctcggcccggacgcctccgaggccccgctggggacagccgatcccccgcccctgccccccagctcccggccgcccgccgttgccatcgggttcccnccctactatgcgcacaccgctgcgcccctgggacaggcccgcgccgtgggctaccccggggccccgccaccagccgcggacttcaaantgctagccctgaccgaggcgcgcggaaagggccagtccgccaagctctacaacggccaccaccacctgctgatgactgagcagaactgggccaaccaggcggccgagcggcagcccccggcgctcaaggcttacccggcagcgtccacgcctgcagcccccagccccgtcggcagcagctccccgccactcgcgcacgaggctgaggcgggcgcggcgcccctgctgctggatgggagcggcagcagtctggaggggagcgccctggcagggacccccgaggaggaggagcaggccgtgaccaccgcggcccagatgcaccagccgcccttgcccctcggagacccaggtcgggccagcaaggccagcagggccagcagcgggcgggccagaccggaggacttggccatctag

SEQ ID NO: 30093 - DNA, 267 bp, Homo sapiens
tcttttctcttcctgcctgtttctgtcttgctcttgcattcctgggtctctttcttcttactaaccccttctgcctcccgggtcaggcttcacctcctgccttcctccccttctcttgccttccctctctgacaaagcactttcctgtcagttatactgcttggattcagggcacttagcacctagattcagggcccactgtgaagccctcctttgttcacttgatgaaataattgcagtaacaagactaaaatttaatgaacactt

SEQ ID NO: 30094 - DNA, 660 bp, Homo sapiens
tgtgtgttttcaaactcatgggcaaattcaagttcagatggtgcacttttcattgattaatgttatagcaaatgtcagtttgttttcttcagtttctgctgatggttttaactggcacagaaagtatttattcaaccttacaaaactgtgttaagttgtattgtgatacagtttattgacttgtacagtattgtcattacaacccattcaggtatgcatgaatctgaagcagaacaccatttaagactggtgctgtataatataattcctacagatgtgggtccagggaatagaactgagcctgtcttttttttaatgttaagcaggttacccccagtggggcttctactagacatctctccatttggtctcttcttacactccaacccagcaggaacagttaataattggatgtttataaaatgggggtaaaagggtttactgtgatggatcctggctatccctctaggaggagacctttgcttcagcaatggtgtcttcatcctcgcagcctgaagctgcttcatttccttaggtctgttgtgttttctgtaaagtgttaggaattctggatatttttgtaaaagaatcaagatttgtataaaatgttgtttacagatcttttaatgaataaatacataaaccccccacagaaaaatt

SEQ ID NO: 30095 - DNA, 295 bp, Homo sapiens
ctattagctctcttgtccgtttgccatatgtcatttccttttagctatctaggaagaagagcttacagggtaaacttcccatttaactatcccctttccattttctcactcactttgttacagtcctctctgtgtttttggtggcatctgcttttcctgtgatactttccattttctcttctcctctgtgctgctttaatttttctcttccacgtatttcctgggttttgccagctctttctctctctcttttttgagacagagtctcactctgtcacccaggctggaatgcagt

SEQ ID NO: 30096 - DNA, 1124 bp, Homo sapiens
aaaccatatctcaggtaaggggttcataccaataatatgtaaggaactcaacccagaaatgagaaaacaagcttactaaaaaataagtaaaggagttgaatagacattttctaaaaacagacatacaaaaggccagatttttatcaaaaatgttgataaaaaacatcaacattcctaattatcagagaaatagatgtcaaaaccatgaagatattatctcacagatgttactgaggttattataaaaaagatgtggcggggcacggtggctcacacctgaaatctcagcactttgggagtccaaggcaggtggattgcctgaggtcaggagttttagaccagcctggccaacatggtgaatccccgtctctactaaaaatacaaaaaattagttgggcgtggtggcatgcacctgtaattccagctacttgggagggtgaggcagaagaattgcttgaacctgggaggtagaggttgcagtgagccaagattgcgccactgcactccagcctgggtgacagagcaagacttcatctcagtaaataaataaataaataattaaaaaatgatggaagataactattgattagaatgtggagaaaacggttgtacactgttggtcggaattgaaattattaccaccatcttggaaaatagtatgaagctttctcaagaaattataaatatatttacattatgattcatcaatgcctcttctggatatacgtctaaagaacttaaaatcagtatgtcaaagagacatctgcaatttcatgttcattgcagagttattcataatagctgtgatttagaaacaacctaagtgtttatcaactgaagaatggattaaaaatatgtgaaaatttgaaacccttatacactgctgatgagagtttaaaacagtctggcagttcttcaaaaggataagtatagaattaccatatgactcagtaaattaactcctatgtatacaccaaaaagaaatgaaaacaaatgtctactcaaaaggtagcatacaagtacttacagcaacaaaaagtgggaagcaacagaaatgtccatgaattgcagagtggattaataaaatgtggtctgtccatgaaatacaatagtatttggcaata

SEQ ID NO: 30097 - DNA, 438 bp, Homo sapiens
tacacataaaaagtctggaaggatatgcaccaagtttaatcatggttgcctctggggattaggatttcagtacagaagagagaaagagatgatcacctccacacacctgtgtggcttaattttttattagtatgttgggctttactttttattttttatttattattttttttgagattgcctatatatataatacagttacattaaaagagcagattatacggccaggcatggtggctcacgcctgtaatcccagcactttgggagaccaaggccggcaggtatcttgaggccaggagttcgagaccagcctggccaacatggtgaaccccatgtctactaaaaatacaaaaattagctgggcgtggtggtgcacacctgtaatcccagctactcgggtagctgaggcacaagaatcgcttaaaccttggaggcaga

SEQ ID NO: 30098 - DNA, 1193 bp, Homo sapiens
tctcttccatacaacggctggcctctaccaagttaactgcttcgtggggggaaaatattgcctttcctttggtctgcatgttttaagggaaataccaaatacacctacaggagtttatcaataatagacaaggctgatttcaaactctttcaggagataaactggaggggaagacgaatggcaggagggtgaagaggaaactgaattactgtgcaaacacccgccactcaaatccgggtggttactgcagagtgaataacgataggtactatttcgtgtaaggcaaagtcctttgaaagggctcctagagcgtcaaggcctccacctgatgaatgaatgagtcaggcaggcccagctccacttcacggatgggaaaactgaggtacgaggcctcgctgaaagatgcgaggcagagcggagaaccagaagcaccacttctctcaggctgatgctctaatctcggctccccccgcccctacaatggcgtagacggcctccgccgcccgactcacacacaccctcccccgggaacggcaagtctcctcgggttccaaggacagggtcaaaagacagggtcaaaagacaagaggcccgaggcgctcccgccgtgatttgcagccagataccgttgggagcgcagccagagagcgttgggagcgtgcgtacccccagcccaacatggcggcggcagcggccgcccccgaccccaagccctccctcagggcccgaggcttctcctcagggccttccggtgggcgggaagacagcgcaaccccgccaggcctttctcgtcgctgcgcctgctcgctgaaggagtcacctacccgacgagactaacggctgcggcgcggaagccccacagcccgccgagaaccaggaatacgagagccaggcggcgcggcggcgggacctgtactgagcaagaaagaagatttcaaagtaatttattgttatgagatccgtgcttttatcttgtctcagactcccaatgataggcacatactctcctctgtacatttaatgaaactactaaaatatttcgatttaaatcttccacctatttgttttctgtgtatcctacctgttcccgaccttgacattttcaaagaatacaggttacttattttgttttttggtggtggtgagtttttttggggttttgttttttggtttttggttttatttttggagac

SEQ ID NO: 30099 - DNA, 1170 bp, Homo sapiens
cgagccaaaggattcttggctccaagcctggtcctggctgttagtttggaactcatgcacccagatgctaactcgccctcagaatgcagaggggatgaaacactgaccggacaattcaatctgtatatgggagataaactggaggggaagacgaatggcaggagggtgaagaggaaactgaattactgtgcaaacacccgccactcaaatccgggtggttactgcagagtgaataacgataggtactatttcgtgtaaggcaaagtcctttgaaagggctcctagagcgtcaaggcctccacctgatgaatgaatgagtcaggcaggcccagctccacttcacggatgggaaaactgaggtacgaggcctcgctgaaagatgcgaggcagagcggagaaccagaagcaccacttctctcaggctgatgctctaatctcggctccccccgcccctacaatggcgtagacggcctccgccgcccgactcacacacaccctcccccgggaacggcaagtctcctcgggttccaaggacagggtcaaaagacagggtcaaaagacaagaggcccgaggcgctcccgccgtgatttgcagccagataccgttgggagcgcagccagagagcgttgggagcgtgcgtacccccagcccaacatggcggcggcagcggccgcccccgaccccaagccctccctcagggcccgaggcttctcctcagggccttccggtgggcgggaagacagcgcaaccccgccaggcctttctcgtcgctgcgcctgctcgctgaaggagtcacctacccgacgagactaacggctgcggcgcggaagccccacagcccgccgagaaccaggaatacgagagccaggcggcgcggcggcgggacctgtactgagcaagaaagaagatttcaaagtaatttattgttatgagatccgtgcttttatcttgtctcagactcccaatgataggcacatactctcctctgtacatttaatgaaactactaaaatatttcgatttaaatcttccacctatttgttttctgtgtatcctacctgttcccgaccttgacattttcaaagaatacaggttacttattttgttttttggtggtggtgagtttttttggggttttgttttttggtttttggttttatttttggagac

SEQ ID NO: 30100 - DNA, 1847 bp, Homo sapiens
tatttctaaggtggttcccatgatggcatttcttgataagcccactttgagccgtttaatgttttgtaggtgtttctgtgagtctgataataccagcactaaaaacagttcagtatatagacatttacaagaggtcttaggcctcttcagaattcagttaatgtctttctctttgaggctgctgaatgttaggtaagaattcagggcaagcattcccgaccatcatcaaattggagacttggagtttctattggctggaagaaagttgacccacaggcaaaaccagatgtaaaccaagtttgtcttgggtacttttcaaattcttttcacagcatccttttctcatccctcatggtggcctctggccctggaaaatcctcatgatagcaacttatcaggcctgtttcctctgatagatctggacttttccccttaagtgctttcctgttgggcttctcagactatggagaactgctcatagttgagatctaagagacaaattaccctatggtgttcaagaatggccgtatttagtatactgcctgtcctggaagtgttcacatttaaaaaggcatgactttccaatgggcaaatatcagacacctacatgcatagataagggaaatatgttttacttaagcaaacttctaggcattgaatctcagtgtttaggtgcagagatggaattcctataagcaatgcagtcattcaccacatcaggaaggccaaaaaatgaacactctcgtaattttgttattatctggaaagttctgatatgataatgaacctaaaatactgaatagatagtgaacatcctaaaattccactgaccagaatccattcccatggtcatcatctgtagagggcatgatacaatgacaggcctgaggtatgattataattctggagtaatttaaagcctatatttgttaaactttaacagatggacacacattctctgattttctacttggctctttcctgtactagaaatgcgcatttaactaaaccttcccagcttttctgttcagtgcctgacttacactactcccttaggcaggaggacagtgggtgtctggggaataaaagccaagagctccaaacagaggattttggatacaaagggcagccaccaggaaatagctttgtgagagggacagactatctgattcccatttgtacaaacatgtccaaagcaaaagcacagcattctaaagtggatgcagaaattagtatacaatggcagttctggccagtgcagcccagcatttttctgttgtgcatggaaagaacacagtgaaaaggcaggcagggcatccggtgcaaagtgcaacagacatagacacacaaatccagttttcctgatgagagagggagctatctcttcataagtgatgcaatgcaatgcaggcatgtacaagtacaaggaaagatttatttttaaaaaatcatagtgtaactggatgaataccagcaacagcacctgctaaagcaaacagcctgttcattaaaaactggacttgagggaatggagaaagaatctgaggagcctgcagtcagcatgcttgcagagaccttatggctacagaagacgatgattaacccatagaggttcaatgtagttttcaagaagagggtgggaaagcataagatggggactaagactttgcctttaaccttcatgacatgaagaattgaatgactctttgttggaaaaaatggcagttatgagataattggatccatgttaattatatatatttctgtatatatagtaagtggttattgatgtgcctttgttaaccatttcactatttaataaatgtgtgtgtagtttaaaaaaaaaa

SEQ ID NO: 30101 - DNA, 741 bp, Homo sapiens
tatttctaaggtggttcccatgatggcatttcttgataagcccactttgagccgtttaatgttttgtaggtgtttctgtgagtctgataataccagcactaaaaacagttcagtatatagacatttacaagaggtcttaggcctcttcagaattcagttaatgtctttctctttgaggctgctgaatgttaggtaagaattcagggcaagcattcccgaccatcatcaaattggagacttggagtttctattggctggaagaaagttgacccacaggcaaaaccagatgtaaaccaagtttgtcttgggtacttttcaaattcttttcacagcatccttttctcatccctcatggtggcctctggccctggaaaatcctcatgatagcaacttatcaggcctgtttcctctgatagatctggacttttccccttaagtgctttcctgcagtcagcatgcttgcagagaccttatggctacagaagacgatgattaacccatagaggttcaatgtagttttcaagaagagggtgggaaagcataagatggggactaagactttgcctttaaccttcatgacatgaagaattgaatgactctttgttggaaaaaatggcagttatgagataattggatccatgttaattatatatatttctgtatatatagtaagtggttattgatgtgcctttgttaaccatttcactatttaataaatgtgtgtgtagtttaaaaaaaaaa

SEQ ID NO: 30102 - DNA, 374 bp, Homo sapiens
ggtaatagtctacttttttattattaaacttttgttatagtaatagagaaataaaattattaacaggatagtatcaaacaaccagttttctaatagtagtattgaggtaataagcagtcctacttacaaatggcctataatctaaaggcatttttagcctgttggtttaaatcaaaactcgaaatgctttcttcatagaaacagctctggccactgtattcctaagcaaactcattaaagagtcatttgacctattttgcacccccaaaattatacttacaataatacttctatggcaaaatgtgctcagaattttaatagatgataactactgaagctttgacaacaagcattaagagtcttctttcttctgc

SEQ ID NO: 30103 - DNA, 418 bp, Homo sapiens
tctttttttttttttttttttgagacagggtctcattctgtcgcctaggctggagtgcagtggcgcgatctcggctcactgcaagctccgcctcccgggttcacgccattctcctgcctcagcctcccaagtacctgggactacaggtgcccaccaccacactcggctaattttttgtatttttagtagaggcagggtttcaccatgttagccaggatggtcttgatctcctgaccttgtgatccgcctgcctcggcctcccaaagtgctgggattacaggcgtgaccaccgcgcccagcccactcaattgttcttgaaagggcacacctgagttaattttcctgacaaagatgtgctgaccttccagttactctttttttctttatttttatttttgagacggggtcttggtcgacg

SEQ ID NO: 30104 - DNA, 434 bp, Homo sapiens
gcagcatttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgttactgtcacaactgttatgttttccagtaaactagaagtacgatatttgatatttcaccacctaaatgtaatgttgattcctcaagaatgaaatgaaggcactacattgaaatatgttttgtataaatttgtcatgttgaacaacattttagcatggtaagttcccttagctatatgaattttggcatgtttcagagagatcagtaaataaaatattagataaaatat

SEQ ID NO: 30105 - DNA, 264 bp, Homo sapiens
gcagcatttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaagagtggtatacgggtggtatacggggtacctgagctacgaacttcgtacatcatgggtcact

SEQ ID NO: 30106 - DNA, 225 bp, Homo sapiens
gtcagaatttgagactaaatacagattggagtattcacttgggaattcaacagagatccatcttaaggaacattccaaatacacaatcagaaagaaagcatttgtgtgcttttctgctcctaggaaaatgcagagagaaagaaaaggttactgtttcatgtgaactgatttctcccttctctgtggtaggcagagaacacatcatcccacctggaacgtgagtca

SEQ ID NO: 30107 - DNA, 619 bp, Homo sapiens
aagtcttttaaaaattttttttttttaatccttttaaaaaattctttgagcttttattattagttccactttacagctgagaaaactaatgtttaaggacattaagaaacttccctctggaagagttagaggtgagattcttagccacttcaaccttgtgcctcttataaacatgcatgaataaacttgagtggaaagaaacttcctggcatgcaagactattggttagaattgagatgtttctcctcagaaatgatcagagtctagacattgaagtcaagtttgctaaaaagcaaggttatagatagaaaagaaaatgaaggccaaatgcggtggctcatgcctgtaatcccaacaatttgggaggctgaggtgggaggactgcttgagccaaagagttcaagaccagcctggacagcatagaaagaccccatcttgacaaaataacaataataataatttagtcaggtatagtgatgtgcacctgtggttccagttactcaggagggtgagggaggaggatcacttgaggctgggagggaaaggctgcagtggtgagccatgattgtaccactgcactccagcttgggcaacagagtgagaccctgtctccaagaat

SEQ ID NO: 30108 - DNA, 487 bp, Homo sapiens
atcttccctctctcacgactaaactgtttttaattaacaggtatttcagcaaaaagtaaataatctgaaagactaatagtatcaatagaggtagtacaaccactaggaaaaaaagttcaaccttttgtttctattgatatgttctccatatttagatcctcaaaactgcagatatatacagtcattcatgacactatgtaaatagcagataacaggaaaaacaattcaatacttaaccaagttcactggagcacaaagtaatcgccactcaagaatgctgacacaaaaacctgaaggaccgatctcaagttccaatagcacgcagataagctgagcccctatgcagttactcatctgaacagaagtggaagattaacctaccctcactcatttcacacactaacctgacaaggcagcaggcagtctcttcggagcttgttcatcattcagtctgttccagaagtaaccgattccgttaggatctgtg

SEQ ID NO: 30109 - DNA, 425 bp, Homo sapiens
gctcgacgagatagggtctcactatgtggcccaggctgtagtgcagtggtgtgatcacagctcactgcagcctcgaccccctgggctcaggtgatcctcaaaactgcagatatatacagtcattcatgacactatgtaaatagcagataacaggaaaaacaattcaatacttaaccaagttcactggagcacaaagtaatcgccactcaagaatgctgacacaaaaacctgaaggaccgatctcaagttccaatagcacgcagataagctgagcccctatgcagttactcatctgaacagaagtggaagattaacctaccctcactcatttcacacactaacctgacaaggcagcaggcagtctcttcggagcttgttcatcattcagtctgttccagaagtaaccgattccgttaggatctgtg

SEQ ID NO: 30110 - DNA, 966 bp, Homo sapiens
atgtccttacagaaactcatggagccagaagctgggaccaataggaccgctgttgctgagttcattctactgggcctagtgcaaacagaagagatgcagccagttgtctttgtgctcctcctctttgcctatctggtcacaattgggggcaacctcagcatcctggcagccgtcttggtggagcccaaactccacgcccccatgtacttcttcctggggaacctatcagtgctggatgtcggatgtatcactgtcactgttcctgcaatgttgggtcgtctcttgtcccacaagtccacaatttcctatgacgcctgcctctcccagctcttcttcttccaccttctggctgggatggactgcttcctgctgaccgccatggcctatgaccgactcctggccatctgccagcccctcacctacagcacccgcatgagtcagacagtccagaggatgttggtggctgcgtcctgggcttgtgccttcaccaacgcactgacccacactgtggccatgtccacgctcaacttctgtggccccaatgaggtcaatcacttctactgtgacctcccacagctcttccagctctcctgctccagcacccaactcaatgagctgctgctctttgtagcagcagccttcatggctgtggcacccttggtcttcatcagtgtgtcctatgcccatgtggtagctgctgtgctgcaaatccgctctgctgagggcagaaagaaggccttctccacatgtggctcccacctcactgtggtgggcatcttctatgggacaggtgtcttcagctacatgaggctgggttcagtggaatcttcagacaaggataagggggttggggttttcatgactgtgatcaaccccatgctgaacccacttatctacagcctcagaaatactgatgttcagggcgctctgtgtcagctacttgtgggggagcgatcactgacctga

SEQ ID NO: 30111 - DNA, 909 bp, Homo sapiens
tgtagggctacttctctgagaacctatcaattaggcataaaggctatacgttagtttttactgctttgtgtttttttgtttatttgtttgtttgttttttttgagacggagtcttgcttttgttgtccaggctggagtgcaatggcatgatctcagctcactgcaacctctgcctcctgggttcaagtgattgttctgtcaaagcctcctgagtagctgggattacaggcatccgcctctgtgcccagctaatttttgtatttttagtagagatggggttttgccatgttggccaggctggtctcaaactcctgacgttgtgatccgcccgcctcggcctcccaacgtgctggggttacaggggtgagccaccatgcctggcctgctttgtgttttaacagagtaagaaaatagacttttcctttgctctagtttcaatcttcttaatataggtaggactttttcagataaatttatgattaattacaaggaaaaggatagtatggatgatttcaggtaagttataggcataatttcaagaaacaaaaaatgtttttattgtgatagagcatctcaaacacctttagaatctacctctttttcctgttccccccgttatttctttgtttcaggcccttaacatctctcatatacactggtatttcttgcctctggccttgccgtctattctgtcttcacactgcttttttctttacacagctcttttcacagccccctcagttagagtacagattggattgtgtgtctccctgctacccacagaataaaacttcaaatgtgatgattttggtcttttgttttattataaaatattcaaacatggaagtatatacagtagaaaataagttttctccctgattgatttgtattagtaccatctctgctatt

SEQ ID NO: 30112 - DNA, 523 bp, Homo sapiens
  misc_feature (387)..(387): n is a, c, g, or t
  misc_feature (398)..(398): n is a, c, g, or t
  misc_feature (410)..(410): n is a, c, g, or t
  misc_feature (452)..(452): n is a, c, g, or t
  misc_feature (459)..(459): n is a, c, g, or t
  misc_feature (479)..(479): n is a, c, g, or t
  misc_feature (484)..(484): n is a, c, g, or t
  misc_feature (505)..(505): n is a, c, g, or t
  misc_feature (518)..(518): n is a, c, g, or t
tcaacttgcaactcaaaaaattacataagtacttttcctcaaaacaaccatcatattttggtatgcctaaaaagggctttatgcatacttcctatttcatcaaacagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttgggattaaatacatatgggatgttactctcttggcaccaaattatcttgatacattccaaatttgtctgggttaaaaatagggtggtgggtattgagggccaggattttggcaaattacnggaggcttccnggcacttaaggnggtttttttgggattagggtttggcctacctaccccggtggnacctttnccgggatttttttttccccncaggnccagttggtttccccttgggntttttggcccgtntgggt

SEQ ID NO: 30113 - DNA, 404 bp, Homo sapiens
ggtttggtcagagtgtgaggaaaggagaaatgagaccacagataagaaccagagtgtgaaggatcttgcacttgatatgaaaagagttttgcctttttcctgagggcatcagaaagtcattaaggtgggtgtggtggttcacgcctataatcccagcactttgggaggccaaggccagtggatcacctgaggtcaggagttcaagaccagcctaatcaacatggtgaaaccctgtctgtactaaaaatacaaaaagtaactgggcgtggtggcgcgtgcttgtagttccagctgttcaggaggccgaggcaggagaattgcttgaacctgggatgcagaggttgcagtgagccgagatcacaccgctgcactcccagctgggcgacagagtgagactctgtctc

SEQ ID NO: 30114 - DNA, 378 bp, Homo sapiens
ccaaattcacacaattagtaaggggtggggaggcatgacgaacacaggtggtcacaacgttaaacctttcctagaagctccaattattccccgataaccctgagagccctaacatttcatttccattcagaccagcctcagtctctctgcccatcctctctccaccccacactcagcctatctgtctcatttctcaacctcagcaggcgccagaagcccatcttctccccatctctgattctggcatcttttcctcttgccttcaaatgccctgtggactggattctttttaatttttgtttacttacttatttgagacatagactcactgtcgccaaggctggagtacagtggcaccatcacagctcactgcagcct

SEQ ID NO: 30115 - DNA, 459 bp, Homo sapiens
gaccacatgaggtcacatgaggtcaggtgtagaattttctacttgtggcatcatgtcaatgctcaaaaagtttcagattttggagcatgtccgatcttcaggttagagatgctcaacctgtattgatgatacttgttcttctgtcagttaggaaaatatacttgtgggcctggcacagtggctcagcccgtaatcctaacatggaggcctaggcgggaggatcgctcgagcccaggcgttcaagaccagcctgggcaacacagaccctgtctctacaaaatactttaaaaattagctgagggtggtgcgtgcctgtagtcctagttactcaggtggctgaggtgggaggatcacttaagcccagcaggtcaagtctgcagtgagctgtgatggtaccattacattctacactctagcctgggcaacagagtgagaccatgtctgggaaattaaaaaaaa

SEQ ID NO: 30116 - DNA, 322 bp, Homo sapiens
aaaaggtgacattaaaaggaaatattatgaaaatttgacaccaataattttgaaaacttagatgaaacaaacaaattcataggaaaacataactcaccaaaactgacttaataagtagaaaacctgaataggtctgaaaccattcaagaaattgaatcagtggtttaaatattcccacaaggaaagcaccaggtccacatagaaagacctacaagcaaatcctaccaaaacactcaaagaagtcaaaactccaatccaacacaaactcttcctgagaactgaaaaaatagaactcatcctctaacttaatttataagaacag

SEQ ID NO: 30117 - DNA, 165 bp, Homo sapiens
ttggtttttcagcccctttccattcttctttcctcagttttccccatgtcagtaagcaaggccaccacccatgcagtagctcaagccaaatgcctggaagtcatccttctttcctctcagtccacatctctcagttcacaagtctgcttactctacctgcacaat

SEQ ID NO: 30118 - DNA, 718 bp, Homo sapiens
cagcctgattctctgtattaatttaggataaaattcagttattaattagacctgatctttctttgtcaataatttagaagcatatgtcctcggcacataatgttggctgactgtttggttaataatatgttcttgaagacatacttctggaaatctgaaattgataagtgaagaggaactttcttactattcataaataaggttgtattcagctattctgactctagtagggttaattgctaacatttgacctacattattttattttttcaatttctcaaaaactctgaaaagtataggccaggggccttggctcatgcctgtaatgccagtgctttgggacgccatggtggagggattgcttgaggccaggagttcgagaccagccttagcaacatggtaagacccccatatctacaaaaaataaatttgcctggcttgatgatatgtgcctgtagttctagttacttgtgagggtgaggagagagggtcacttgagtgcaggagttcaaggctgcagtgagctatgatgatgccaccatactccaggatggtgacagagactctgtctcttaaaaaacaacaacaaaacaaacctctgacaaatacagaaaataacagcatacacctgatagtcccattttataggcaagtgacatctagtattttcatagtaaaatatcatgtagtgtcatctgatactttcttctttttacta

SEQ ID NO: 30119 - DNA, 473 bp, Homo sapiens
ctctgtgttagtgagaaacaaacttgtgttaagccatcatgattttaaagttgttagcagtcagcttgctccaataggatgaacactaataaacatagcggtaacaacctgctgggtagtatcattattctcactttgttggtgaggaacttgaggcccaaaatggtcagaaagttagcagatggcagagctggtatttcaagtctattttttaatccctatcttgcactccttggtcacgtaaaccttgtgtgaatatgtttgatgctttaatggagcaaagaggagaatattaaaataccaggtttcttgggtgggatgtggagtgaggaggaagaacacaaaacggaaaggctccacgcatcagaagccaagctttgggcactccacagttttgctaaagacttccctgtctgctcacatctggtctgttccccagtatcctcactgtattaaagttgtttctttgtcat

SEQ ID NO: 30120 - DNA, 615 bp, Homo sapiens
aaggcctacaggcagtgggccaatgctaaaagaagaaaaaaaaatgttaaccaagacttgtatgcagtaaaactgtctttcaaagataagggtgaaattaagacattcccagataaacaaaagctgaagaagttttttagcactagacctgccttgcaagtaatggtcaagagaggtaatggagagaagtcttgtaggttgaaatgaaaggataccatacagtcactacaagttgtatgaagaagaaagatctcaaagtaaatacatggtcagctataaaagtttgtattgttgtaaccgtggtttataactccatttgtttgtttgttgtctgcatgattgaagagacgtacatttagggctgggcatggtggctcacgcctgtaattccagcgctttgggaggctgagatgggtggatcaccaggtcaggagatcgagatcatcctggttaacacggtgaaaccccatctctactaaaaatacaaaaaaattagccgggcgtggtggcaggcgcctgtaatcccagctactagggaggctgaggcaggagaatggcgtgaacccgggaggcggaacttgcagtgagccaagatcgtgccagtgcactccagcc

SEQ ID NO: 30121 - DNA, 394 bp, Homo sapiens
gaccaagaaaaaggaagcaatatggaatataggattgagaaaggtattccagttcttttgaagagctaaaagatttgaaatgcaacatcccaaatgactgttacaatcacccataattgtaacaacatttgagaagcaaaggatgattacgcactgagtatcaaagtctccagtgaatgtcagggttgtaactgggaccttggaagtctaattgatccttaaacaatgtctaaaataatttttctcctttgtgccctacaacttcaaaaaagttacatcataattttgtgtaatatcaatatgtggctatcatcatttgaaaagtgagctttttgcaatgtataaactcatatcttttagctcttcaaaagaactggaatacctttctcaatag

SEQ ID NO: 30122 - DNA, 1547 bp, Homo sapiens
attgttattccaataggaaaagcattttatctcttcactttagcctttgctgagtattgtacaaaaagaatgatgctgcactaaataatgaacttctttttgaagaatttaacaactagatgcattttgccttcctggaatccttttgtctgtctctttgcatcgttgactcttgcttatccagagatctcagcttaaatatttccttaaaggtacctttcctgagattccagctggaattgagtccccttagtatactctgccatatcacctcttgcagtttataattacccagctgtttgtatgaatgttatgtctgtgtctcacatcacactttgaatttcagagagagcagtggccatgtctgtttcggtcactgctctataactccagtgtctctcataacagtctgggaaataataagtactaattaagtatttgttaagtggaaatactgctgttagagcttctcctaattagagtgttaaaaatgagataatgtgtgcatgggggaaggggaaggagagggagaggaagtagataaacttgtgatattaccgtgagataatcctcaagtaagtcctctcacctccagggcctttgtttcaccttgtctgtaaaataggacagactgggttcaagatgccattaatatcctatattttgattccagtaacaatgatgacagattatgtaagctcatttgaatggaatatgtgacagctagctccccaaaagaatatttgacaagttctaaataaacatattagaaatgcttgccaactagatgatattatttagagcctcgtacccctgttagaaacaagcatatataattggtatatagtttgtaaattaataagatgtactcttctttcagttttctaattgaagcgtaaagacaaaattaagcagcatatcaaggttcatgtaagttacagttattaggtttaatatttagttttaatatttttcacccaacatcttgttgcatcttccagagtaaatctggggtccataaaccaaaccaggagagggaaaatggaaagagtgggcagaaatctgacagctcttaggtttcttctatttgtgttaatactgagacttttaaaaatcatttttatatgtagtgtttattatgaatagttgtaatttgttctgataaattagttgtattaaacactgttatttggctaatattactaggtataataaaatgatatttagtgggaagacattcatcaaagtagaagtagttaatttgggccaggtgcagtggctcacgcctgtaatcccagcactttgggaggccgagatgggcggatcacttgaggtcaggagttccagaccagcctggccaacatgatgaaaccccgtctctactaaaaatccaaaaatgagccaggtatggtgatgtgcacctgtaatcccagctactggggcggctgaggcacaagaatcgcttgaacccgggaggcggaggctgcaatcagtcaagatcgcgccactgtactccagcctaggcaacagagcaagtctctgtctca

SEQ ID NO: 30123 - DNA, 557 bp, Homo sapiens
cctcaagctgttaaacaagcttggatcccttttctctaaagaaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctata

SEQ ID NO: 30124 - DNA, 431 bp, Homo sapiens
ttttttgggggggggggtgtgtttgtttgtgggggggggtttttttttattgcggagttggctgaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagtaataatattttgggaagtactaaaagtatttagataattgtattacatgtgtatttatatataaagttacttctagcacattgtgagtgtaagacatttgccagcatatcaagtggtggcccccttagtgaaaaaaaaaaacttgcc

SEQ ID NO: 30125 - DNA, 5957 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30126 - DNA, 7030 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcaggtaaagtacttctcttcctggtcaggttgtcacgctcttacttcctgccttgtccgcgagcgcctggaaaatagaggccttgagcccgagcggcgaagtccgggcttgaagctgccgctgggagatttctcttgctgtcacccctcccccctcggccgctccccggcggcccgggctcccgcgcgcagctcccgggcgccacttttccaagctactcaaatgtctcggggaggccctgagcctcgcagatcttttctttaaaaaatcctagtctctatctggaaaagggcgtctccccctacccctcttccttctgccaacggactagtcaccgggtctcagccttcgctggtgacctttcatggtttactgtccaacgggactccgcctggggagctggagagacaaactcttgccactccaaaattagcaagcgctgccagcgtccgacttgaagttgctagtggttagtcccagccttcgcccttcgcggtccgaccgctgagaggagggagacttcgttatgccccgggccgtcaacggcgccaggagctaaagggcgggcagacgaaagcgggcggcgagtcgccagttagtcttcaccgctctggagagagttgctagccacgggatcctgacccggacacgaactcgtttctccacgtcggtgcgcgcttgcatccctggccccgaaagcgtgggaatgtccggaaatgctggcgtatgggagttccttaattagaaatgcgttagcgaatattatacgcttatactatgggcggacgggtggagagccttaaaaacaacaacaacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttcccctgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30127 - DNA, 5937 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30128 - DNA, 5922 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtattatctaggatataagagttatgtcttctcagtggcatgtttagatattaaatcaagtttatcatatgatgtaatgaactttagatggttaatagattagaagagaaaaaaaaaattggggggcaaaattaaaatgtgg

SEQ ID NO: 30129 - DNA, 5813 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30130 - DNA, 5255 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaagctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattactgtgccattaatattggcttcacataggtt

SEQ ID NO: 30131 - DNA, 5711 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30132 - DNA, 6353 bp, Homo sapiens
  misc_feature (2086)..(2086): n is a, c, g, or t
  misc_feature (2138)..(2138): n is a, c, g, or t
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatgtaagtgccttgattgatattaccaatttttatattagtttttaaccattaagtcaaagcccttctcttttcctagagaaacatgaagactgaagtgaaaaaaaatctctaaatattgttttgtgtgactgaatgtgttagctcatgcctgtaattccagcactttgggaggctnaggcaggaggatcacttgaggctgggagttcaagaccagcctgggcaacatngcaagaccccatctctacaaaaaaaggaattatgtggtgaacttatccaatgtgaggactatctggctgtgacacctgtcatcccgttgatcaccagggttgaatttattaaattaggcatattaattcattgaagttgactttttagtatcctgctttaagttgggagttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30133 - DNA, 5793 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30134 - DNA, 4964 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctata

SEQ ID NO: 30135 - DNA, 5477 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagataaaaaaaaaaaaaaaaaaaaaaaaaaaaaaaaaaaaaaaaaaaacaaaaaaaaaaaacaaaaaaacaaagagagcaagacaaaagacaaaccacaaaacgagcacaaacaccaccaaccaaagagtaaacaagcacacacacggacgccaaacacacgggcgacaacacacccaaaaaaaaaaaagaagaaaaaaacaaatacagcgagagggagacacaaatcgagaacaccaccgcgacaacaaccgcaacccacgcagcacgtaagacaagaaacaacacccgactaataagagtaaacgaatcccgggactacaacgagcatccagagcacaaatcgatcactcggaaccaaacataggacagccaaatagacgaatgaggcaaccgagacggcgacacgagcactaccagatggaaaaacaacaaacagagccaacagaccaagaaagaaacagaagaaagacaagaaaatcaaacagacgagaacgcactgcagaagacagaagagaagaagcgagcccagccagcagaaaggagaaagaaccaacggacaacagcaaccgcaacataca

SEQ ID NO: 30136 - DNA, 5100 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagattagaaaaaaaaaaaaaggggggggccaaaaaacctcgagggccagttagcgtacccgttgtttgtaaaaggggcctaagaggagggtttaaagaaaggaggcgggtaaacgtgcgggaagtctgggttcggagagccactgtggggtatggggccaaagaagccgaaaatagtgggaagcatggggagtagtaaaaaac

SEQ ID NO: 30137 - DNA, 6993 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcaggtaaagtacttctcttcctggtcaggttgtcacgctcttacttcctgccttgtccgcgagcgcctggaaaatagaggccttgagcccgagcggcgaagtccgggcttgaagctgccgctgggagatttctcttgctgtcacccctcccccctcggccgctccccggcggcccgggctcccgcgcgcagctcccgggcgccacttttccaagctactcaaatgtctcggggaggccctgagcctcgcagatcttttctttaaaaaatcctagtctctatctggaaaagggcgtctccccctacccctcttccttctgccaacggactagtcaccgggtctcagccttcgctggtgacctttcatggtttactgtccaacgggactccgcctggggagctggagagacaaactcttgccactccaaaattagcaagcgctgccagcgtccgacttgaagttgctagtggttagtcccagccttcgcccttcgcggtccgaccgctgagaggagggagacttcgttatgccccgggccgtcaacggcgccaggagctaaagggcgggcagacgaaagcgggcggcgagtcgccagttagtcttcaccgctctggagagagttgctagccacgggatcctgacccggacacgaactcgtttctccacgtcggtgcgcgcttgcatccctggccccgaaagcgtgggaatgtccggaaatgctggcgtatgggagttccttaattagaaatgcgttagcgaatattatacgcttatactatgggcggacgggtggagagccttaaaaacaacaacaacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttcccctgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataagtctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30138 - DNA, 4849 bp, Homo sapiens
aacagcgaacatacttactaaagtgtgttaataaataaatgcttgtagcacataataataacagtgaaatgtctgcacagccgctttccacacagacatcataacaaaaatttccagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30139 - DNA, 5850 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgaggttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30140 - DNA, 5199 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccgggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30141 - DNA, 4432 bp, Homo sapiens
gtaaaaatttgtgtaaaatcttacgatcgagaccaaatggacaagctggctttttttgaagaaagtaatacgactgaattactagcatcattgggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30142 - DNA, 4577 bp, Homo sapiens
tgtgcttatagaatctcctttcttaaatcgaatataaaatgtatggtttcatttcagtgtaggtttgaaagtaaatatctgtccagatttaatgaactcatattttaacagagtcgagagaaagaacttatgggtttcagcaaatcggtaaatgaaggcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagatgttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30143 - DNA, 4478 bp, Homo sapiens
ccctactctgaagtcttagaaccgtggggatgctaccccctagtggcgtagcacagtaacaaacaataagcatttggcttcacaggttaatcttttagtagtccacaaatctgatagagggataggatttgggtttttctagatagatttttaagggttttatcatgtccctacttgatgccatttttcaatgacactagtatctctaattatttttaaataaaaaaatttgtatagtaagtttattgtatagtaacttgtaagtatattcgtaaaaggtaaaaccaaaattttactcctatggtaaaatttttatatacctagacattgtagtcactggaaaatgtgttattttccctccaacttagaaaggcaaaatagctgtcataatcaaaaatacaggtgcttcttcaactatggggagagggatcatcttggaataaggagagttttaggatcctgccttattaagagcctggacatatttatagaggaagtgttccaggtaggaaatgtggttttaaaatatgtgcacattcaaaataatgacttacaatatacttgctttgctaggaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30144 - DNA, 3985 bp, Homo sapiens
ttggaacgatacagagaagattagcatggcccctgcgcaaggatgacacgcaaattcgtgaagcgttccatatttttaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30145 - DNA, 4107 bp, Homo sapiens
caggaaggatagtttagaaaattccgtgtagtcagagcatatttatagctaaagaagaataattacaacctgaaatcaggagagaaggatgacagacctgaggccctgccagagacagttttccttcataagaggtcaggtgtttgtagaagtagttttactattagattgagagaatatagaaattacagtgaatagtcgggaaaatacttgttaaagctagctaatttaactctgattataaagaaaagaagaactagaggaccctgagaaatgcctttaaatatgtcaaatattgatagtattgggtaacataaagatgtatgctcctataacttgttttataatctcaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30146 - DNA, 3917 bp, Homo sapiens
tgtgcttatagaatctcctttcttaaatcgaatataaaatgtatggtttcatttcagtgtaggtttgaaagtaaatatctgtccagatttaatgaactcatattttaacagagtcgagagaaagaacttatgggtttcagcaaatcggtaaatgaaggcacgtgttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30147 - DNA, 3802 bp, Homo sapiens
ggtaccgtggctcagaaagaaaagaaagtcgagagaaagaacttatgggtttcagcaaatcggtaaatgaaggcacgtagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30148 - DNA, 1427 bp, Homo sapiens
tcctcccacaccacccaaaacacaaacccactcccccctttactcaagtgatagatgaatgcaggcccttgattttaaaaaatggtgtcccattgttggcattttaataatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatcagggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaag

SEQ ID NO: 30149 - DNA, 3114 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattggtaaagtagatttttggggggcatggctttactttttttttttaagaaagtgtaacttatttttttgccttgacaaccatatttcaagtgtcactgtatataaaataagattcattttgtttgttttaaggcacatttatttttaaacattttgcccttacagtttcttgtttacttagctttagataaatacaattatttcatacatatcaagaaaaatactagtaatgtcacacaaacttaaaaccattttatccttttttttaaaagagagactttagccaggcacaatggtgtgtgcctgtagtcccagctgttggagaggc

SEQ ID NO: 30150 - DNA, 2688 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaacaaaaaattaaaggaagttatggatagccttaaccggatacaccagggcttcagaaagaaaaagaaagtcgagagac

SEQ ID NO: 30151 - DNA, 2580 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaagtaagttttttttttttatcagtgtttattttggtggcttttttttttttaacttaaagattattttttcaaaaatactgaaacctgaactggtaagtttggacttttaatgtccaacattcctaaaactagtcaacctagacttagatgactattcttttaattcctgctgacatgttttttaaaaagtttactaaatgagagtttgtagt

SEQ ID NO: 30152 - DNA, 2713 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaaaaaatttttgggggagcatgggccctgagaaaacggttttgtaaaccacatatggtaggggaacggggagcccaagaaggagtagggacacaggggaaagggggtccaaagagagaacgggggcagaacacaaggagggtgggctctctaccaagtaaaaaacgccggggggaaacagagaggttggtaacaaaactcgagagtgacatatcggggagggccaaaaacgaggggactacaacaaaagaggggatctcaaggggaaggccaatatctaaaaatagcccgggcaggggagaaagcagacagcaacagcaagagttagatacacaacatgaacaaaagcactagagagaagagacgagacgagagatgaaacaaaagaacgactaacgaaagaagtga

SEQ ID NO: 30153 - DNA, 2307 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaagttgagatttaagttactgccagagtacaattcttatgaaccaaccgaaaagccctcggaggaaaggaagggaacaattaggagttggtgcttaagaacaggttc

SEQ ID NO: 30154 - DNA, 2201 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagtaataatattttgggaagtactaaaagtatttagataattgtattacatgtgtatttatatataaagttacttctagcacattgtgagtgtaagacatttgccagcatatcaagtggtggcccccttagtgaaaaaaaaaaacttgcc

SEQ ID NO: 30155 - DNA, 1657 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacaggaacaaatgttgatgaacaaagcagatgacaagaggttg

SEQ ID NO: 30156 - DNA, 1572 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagagaccataataagattttattttacaggggtgaag

SEQ ID NO: 30157 - DNA, 2581 bp, Homo sapiens
ggtggtgtgcgtggtattccggggttgccggggattgtggcgggtgcccatgatgtggcggtgtcagggggctgaggccgggtgatcccttggaccccggatgtggagggttgcagtgggttggggtcacgaccgtgtggctcccgcctgggttgcccgggtgagactctggtctccgggaggtgcagttaagcttcttgttaagatcctactaaagtagacctaactgctttttaagtatttaagtatagtacttaagtagagtaagcaaaacgtcagtaagaattttcaaataagatttatagccaacggttcactttggagaattacttaccacacatgatcttaaatactttaaaaccatttaggtaaacagccactaaaggaatgaaaaaaaaaaatctattcttcaactaggatataaaatagagaaacttttaacaatactataattaagaaaatccaataagatttataagcattaaaaggatatgctttggttcttttaaaagagatatctttagtctcatgactccacttccagccaaaatttaagatgccacttgattgtatttacaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcaggtaaagtacttctcttcctggtcaggttgtcacgctcttacttcctgccttgtccgcgagcgcctggaaaatagaggccttgagcccgagcggcgaagtccgggcttgaagctgccgctgggagatttctcttgctgtcacccctcccccctcggccgctccccggcggcccgggctcccgcgcgcagctcccgggcgccacttttccaagctactcaaatgtctcggggaggccctgagcctcgcagatcttttctttaaaaaatcctagtctctatctggaaaagggcgtctccccctacccctcttccttctgccaacggactagtcaccgggtctcagccttcgctggtgacctttcatggtttactgtccaacgggactccgcctggggagctggagagacaaactcttgccactccaaaattagcaagcgctgccagcgtccgacttgaagttgctagtggttagtcccagccttcgcccttcgcggtccgaccgctgagaggagggagacttcgttatgccccgggccgtcaacggcgccaggagctaaagggcgggcagacgaaagcgggcggcgagtcgccagttagtcttcaccgctctggagagagttgctagccacgggatcctgacccggacacgaactcgtttctccacgtcggtgcgcgcttgcatccctggccccgaaagcgtgggaatgtccggaaatgctggcgtatgggagttccttaattagaaatgcgttagcgaatattatacgcttatactatgggcggacgggtggagagccttaaaaacaacaacaacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttcccctgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcaggtgagtgacccgccgcgactcggcgggaacgcgcgctgtgggactggcaggcaaacgcgcccagcccgaggctggctggggttgttgagcgcggagttgacatctgaaggtccggtgtcggtccggtagaggctcaggaaagccatttggcaactttgagataggattcccgtgcaattttggtgtaacggcgctggaagggatgggggcgagcaaacgggttcagttgtgaatttttgtttgtgacctgtggaatggtacaggtcacaaacaaaaattcaatatctttattgtattcccgctaaaatcgagacggtcaatcaagagagcaagtggacttttttcccagagacaatcaatatgactatgtgagcatgatgaaaagttttttgaccctaacctcacctccgtggtgttagattgccgttaaagagaaga

SEQ ID NO: 30158 - DNA, 316 bp, Homo sapiens
tgtggacggctaaatgaacctattaaagtcttgtgtcggagagttgaaatattaaatgaacacagaggagagaaggtgaatcatctgtagactttcattgtaaatcagaatgtttcatttatgatctaacaaattttagtaagtcagatattcatgttataatacttaatgaagaagtgttatattgaaatttatatcttaacatttaagatgaacattctccttattaactgtttttatctaatgtttgcatattttaagttcatattgtacatatgaagtgtgtattcagtctttaaacttttaatttctgtag

SEQ ID NO: 30159 - DNA, 418 bp, Homo sapiens
ggctggttggtttggcttcttgatttttgtgatctttgagaaagggaccaaaacagcatggaaaagtatcaattctttgctaagttgggttattaatgagaactactggcagtttgtgtgcatgttcaattgaagtttttaatccatagaattagtttcagtatgaaatgagtgaattttgaagtaggcctatgacttaataccaacaattgttttctggttttgtttttcctcaaaacaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacag

SEQ ID NO: 30160 - DNA, 375 bp, Homo sapiens
tagaaatcaataatcataaactcaaggcccaacaagacaaacttgataaaataaataagcaattagatgaatgtgcttctgctattactaaagcccaagtagcaatcaagactgctgacaggtagagtatgcatgttaccctaacttgttttccctttccctgccttcacattggaaagggggttactatgtaatgttccataaaatgtttctcttactgttaatttattgaacctgtctgacacattacctaatgggacttccatgacggaaaacctataatgaacatttatcctatggccaattaaaaaggctggtaaacaggtatgccataggaaagtacaggtagactgtaactccccagttgctgtgagg

SEQ ID NO: 30161 - DNA, 844 bp, Homo sapiens
ttattgtccaaaaaatatttgaggttacatgtttgtgtgatttacctgttattacttaatgtttgacttttctttgtttctctttaggaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaa

SEQ ID NO: 30162 - DNA, 228 bp, Homo sapiens
gggccaatttaggcaatacaagagtctggagcttttatgacctaagcagttggggctctccttatgctaccaatgataaatgatagaataagtaagcagagggctgggcgcggtggctcatgcctataatcctagcaccttgagaggccaaggcgggcggatcacgaggtcaggagatcgagaccatcctggctaacacggtaaaaccccgtctctactaaaaataca

SEQ ID NO: 30163 - DNA, 440 bp, Homo sapiens
tccagccagagcacgcacgcacggagccgggagcatgcagcctgcactgcgggggatgtgatgctcggctctaactcgcctggctggcccgccacggacgcctcagcttgcaaccatggtaacgtttctggcgggggacacccccgggagcccaccgcgatgggcagcctcctggtgactgatggacgagtgtccacctcccagaccgagagcgcttagtaggtcggaggaagtggagaggatgtaacacgcccccagccgggagtgaagccctgaggaggtaggagccgcatatgtccatccgtgcattcccaccgtcagcgcgcaggggtgctgtagatcaccggtaggaactttatttggctggtgcttcattatgctgattaaactgcagtggatttgatgggcatgattgcgctggggaagatgcataatgaact

SEQ ID NO: 30164 - DNA, 232 bp, Homo sapiens
aaacatttttgtgtaggaatttttatcatactaatttgtatttctcataaagaacccttgggggtttgacaggaaagtgaatctatttagtaaaattaggaactgggaaaaaatagtgtctctttttttaaatgcttcaaaagaaggaatatttctattgcaataaattattttttgattgcctctgtacctcttcctgctccacattcccattctgaatggcatcattaca

SEQ ID NO: 30165 - DNA, 906 bp, Homo sapiens
agctgtaacactcaccgcaaaggtctgcagcttcactcctgagccagcgagaccacgaacccaccagaaggaagaaactcctaacacatccgaacatcagaaggaacagattccagacgcgccaccttaagagctgtaacactcaccgcgagggtcccggcttcattcttgaagtcagtgagaccaagaacccaccaattccggacacaagagggtgcagcaagaaggctctcagtagacaccacatgcaggtgccttgaccttggactgcgcagcttccagaactgtaagaaataagtttctgtttttatacattacccagcctaagatattttgttatagcagcaacaacagactaagacactatgcctacatagctggccaatggataaatgaatacatttatatacaattgacccatgaacaatgcaattgttaggggtgctgaccttctgcacagttcaaaatctgcatataacttctgacttcccccaaaaacttaactacttacagcctcctgttggccagccttcctgataacatgaacacatacttatgtgtttatgtataacacatacatatgtgttaactgactgtttatcatgtatgtttataactaaactgttggttaacacatacataagttaacacatatgtatgtattaaccaactgtttatgttatacacacacgtatgtgttagccaactgtttatcatatgtacatgttatacatatgtgttaacaaatgtgtgtgatttatgcattcgtgacatgaatatattttgtgaattaatgacatgcctttttcctatttttttcaatatttctaggccatgcagtttatctgtgagtttttaaaaattgtcacaatctccatgataaaaaattccaacatacttattaaa

SEQ ID NO: 30166 - DNA, 704 bp, Homo sapiens
aacctccgcctccgggttcaagtgattctcctgcctcaacctccctggtagctaggattacaggcatgtgtcaccatgcctggctaatttttttgtatttttagtagaaatgggtttcatcatgttggccaggctggtttcgaactcctgacctcaggtgatccacctgccttggcctcccaaagtgctgggattaaaagcatgagccatcatgcccagcctgaaatacatatacagatatatatatttaaaaactgaatcagccttttgtcagctttatgacctaggaatgtctttctcaaggatctgggaaatgtaaacattaccagatagcatacctatcttccagtttctgtgggagggtaacagcctaatcttaatgagtaccttgcaccaagctataaaagtaactcctgtttccacactcccccacccccgaaaagttgatatcttagataacacaagtggtcacatcaattatcaggtaaagttagaatgaactgtgtgaccagtggtgctgtcaagttctcttagttgaggactatttatctcgaaaacatacatgtaatgggctgtacctgcttggctgtacaaaatggtgaaatttccttctgtctttgtgatctcttagcaaagtgcctgtgatgtgcatcacattctcatttaatttttattcaataataaagcttatctttctctactgc

SEQ ID NO: 30167 - DNA, 400 bp, Homo sapiens
ttttggctgcaataagcagaaaagccatcccagagtcactaaacaatttttaaaaaaataaaaaggaatcactccatgtcccaagtcccaagggacgcatctgtagccccttaataataagaggctcatctttcccttcaccgtcctcagcatgtgggttatcctcagctagcatgtctcacagtcataagatggctgtgccaattctggacatcccatgccaaagaaatgattactgttcagcagaagctaattaactttattttatgttgtgtctcttgtacttaacagtaaggaaacgtgtcccatgaactctctagtagactccccaatatcttgctggagagacttaggtcatataaatacctctctaaaccagtctttaagcaggaggatggtc

SEQ ID NO: 30168 - DNA, 521 bp, Homo sapiens
tttttttttaacagtgaaaagtatattttattggcatttaggcctagcgtagttcaattcaaataaaatataacaaagcaacttatttaagctaattgaatataacacataaacaattttttcttaagtttctgctttaccatcatatgattgtgttcatgcaagtacaatcattaaaactgtcctcctaagcatatatcatagcaccaccttttatttgcagtacttgatatgtaaatttcattgtcaaaacatatctggctttatcaatgtaaacatatttgctacaagtaaactttaaaggtaaaagtgaatactaatgaataaatcaaaatagaactgagcatcacatgatataattaagcaaaactccatctaaaaaaaaaaagaaagaaagaaataggcaggacccaagctacatcttccttctcgtagactgttgggaaatggttagctgcgtgagaagcacaggtaggtcatcttcctcccacttaggacattggtttgcagatcttaaaaaa

SEQ ID NO: 30169 - DNA, 697 bp, Homo sapiens
ggaccttccttctaaactgaaacattatttagggaaggcctaaagcagcttgggaggcctgggaatctggccaggctaaggttgtgcaaaacgacaggagctaacattaactgtgccacttcccactgcctggtcctgtaaggctgggcagctaagctttagcagcagttaatgcaaaaaggaatgagaactcagactctagaactggggatttttgattaagagagggttctgaataaaggaaagctaaggaatcgtgtttcgcttggcaaagagtaagaatgtagactccagaggctaaaggcttgtttataaatatttaaaggtgatgagaaaaatatttaggatattactatttttcttgttgccatttaccatttttagcacactggtgcctgttattgttaagtaatatctagtctaatctttgtgattgcacctttgtaagaacggtaaatgttatgtgcttattcctgggaagtagaaaaagggcatcattcatctagggattggtgcagaggactgatcctggcaacctttgatagcagaaggaaaagaaaatgggaggggttgatttctggaacctttgcaagtaaaggaaaaaagtataactctgtgatggccaaattacaaaggataagttgtccgagaagtatatttgatgagaaggtcacaaatcctcaaaggttagaaacaa

SEQ ID NO: 30170 - DNA, 464 bp, Homo sapiens
gatgttacccattttaagacacacctttttaagggtaactttaaggggaaaaaaagcctgcctattatgatattacactttctcatcaaataaagagagcttttgaattatcatcatcatcattattttttgagataggctccctgtcacccaggctgcagtgcagtggtgcagttgtggctcattgcagtctcaacctcccaggctcaagggatcctccaacctcagcccccagagtagctgggagtacaggcacgtgctgccagatctagctaattaaaaaaaaaatgtttttggtacagacaagatcttgctatgttgcccaggctggtctgacacctctgggctcaaactatccccctgtcttggccttctaaagtgctgggattataggtgtgagccaccacgcccagccttgaattatctagacataaattgttatcataagttactcttgtacatag

SEQ ID NO: 30171 - DNA, 378 bp, Homo sapiens
cagaaatcaatagcagaagcaaaattgtaaaattcacaaacatgtggaaattaaacaacacactaacaactaatggatcacaaaataaatcaacagggacattagaaaacatctgagacaaatgaaaacaaaaatacaacataccgaaacttagaagatgcagcaagaccagtataagagagaagtttatagcagtaaaaacttacatttaaaaagaagaaaagcttaaatcaacaacctaacttcacaccttaagtagaaaaacagaacaaaccaagcacaaagttagtagatagaaggaaataataatgatcagagataaatgaaaaagagaatacaaaaaataggaaaaaaaatcaataaaactaagactttttt

SEQ ID NO: 30172 - DNA, 333 bp, Homo sapiens
ctggctggctgccccagtggatgcccatacctgctcctgcctggcttccccactacatcgtgaccccccagtgaacccccagtggcgtgggctgggcacacaggagccctccacagatgcacgtgaggaacgtttcccacctaagccccctcgtgacaggccggctctgggtcactctgagggtgtctagaagaccccagcttgggagaagagttcctgttataacacttgtcttttggctggagatccctgagactttgagattgtcagggaggctttgggattgacgccacatgtctcaggtccccagctgagtcaagtgtcatctgtccc

SEQ ID NO: 30173 - DNA, 2668 bp, Homo sapiens
ggctgtggctgtgactggcgctgccgtgggcgccgcagccctcgcgggagccggacgcggtaatgccccagcggcgcagcgggcggctgcgtccctgagccgctatataagcgcggcagggaacatccggaggggctgaagatgaaggtgcccgcgcatgggcccccgctgattgccagtccctcccgaccccgcgccccgcgcggagcccgaggccgccgaggacccgccttcgccgcagtagcagctggagcagcgacagaggcggcagctgcggcggcggcggcgcccgcgcccctcgcgccagcgcgtagagcggcggcggcagctcgggggccgccactgccccggctgccatgagttgtgcggaggtgatgtatcacccccagccttatggagcgtcccagtatctgcccaaccccatggcagcgacaacctgccccacagcctactatcagccggcgccccaacctggccagcagaagaagttagcggtattcagcaagatgcaggactctctggaagtcacccttcccagcaaacaagaggaggaggatgaggaggaggaggaggaggagaaagaccagcctgccgagatggagtaccttaactctcgctgtgtccttttcacttatttccagggagacattgggtcagtagtggatgaacacttctcaagagctttgggccaagccatcaccctccatccagaatctgccatttcaaaaagcaagatggggctaacccccctatggcgagacagctcagctctctcaagccagcggaatagtttcccaacttccttttggaccagctcttaccagcccccacctgcaccttgtttggggggagttcatcctgacttccaggtcactggaccccctggcaccttttctgcagctgatcccagtccttggccgggacacaacctgcatcagactggcccagcccctccccctgctgtgtctgagtcctggccttatcctttgacatctcaggtgagcccatcctacagccatatgcatgacgtgtacatgcggcaccaccaccctcatgcccacatgcaccaccgccaccgccaccatcatcaccatcaccaccctcctgctggctctgccctggatccatcctatgggcctctgctgatgccttcagtgcatgcggccaggattcctgctccccagtgtgacatcacaaagacagaaccaactacagtcacctctgctacctcagcatgggctggagcctttcatggaacagtagacatagtgcccagcgtgggattcgatacaggtctacagcatcaagacaagagtaaggaatcaccgtggtactgaaacacacaatcttagtgagttaagttgcagcataaatccaagggcccactgggaaaagatactgtcgggtttttccattcagcaataggacacgaaaggcatagaaggagaagacaaagtgtcacgcagttgactggttttcggcctttcttgagaaagcaaagtgggtcccagacattgaagaaaagcatttttatttgtttatttcctcatctgagcctttgccaactgtgcaactctctccttttgttatcttgcttttatcaatatatagctaagtttttgtttcattttgatttttttttttagccaaccaccttgtcaggaaaggatggaaccacacattaaaatgttcattctttcaggaatacaagtttgtagctctatgtgcatctatttttgtagaaatacaaaaagtttggtttagcattgatgggctatttttgagggatgtattttttttaaaattgtaaaaattgttgagttctgtttaaagaacttgctctcagagaagcactggcaaaaatgtttaaaatgcttatctctaagatgtctattatatgctctgtctgtgctttctaggttacctcaaatgttttgtttttttccttcttacaaaagtagctataccgtagtcaaaccaatgcagtattgtttttacattgaatctcagtaaagatttaattccatgctagctcaattagttttgaattatatgtatagcttgaaaagtttttttttaatgactgtgctaaagaaatgatattttattgctttgatttctcccaaagaataacttggaggttgactaataagaaagttggcataaactttcaatcaaatgaagagtttgcctagaggagactaattctctttctagcccatccaaatttgataaatggaaccagaggttatatacaactacaaggaaaaaaatgcatttaaccatgccacctatgagtgccagtgacttattttacttgtttttaattattcattcatggcaatttaaaaagtcatattttaagtgggatttgtttttcctgaagggcatttgaaggaacaatatctgggaaggtactagagaaattacaaagcccgagctctttcttataatgccacctatccctgtaagctaaacaaacaaacaaacaaacaaacaaacagttctatatataatagtttcaacacagaacttaacaagtctctttttttgtttgtttaaatctggctttacttgatttaattcctttttagaaagaaatttagggcaaaataaagtgtatattaggatttaaatttatgccacaatttaaaaataaaaccagagg

SEQ ID NO: 30174 - DNA, 2509 bp, Homo sapiens
ggctgtggctgtgactggcgctgccgtgggcgccgcagccctcgcgggagccggacgcggtaatgccccagcggcgcagcgggcggctgcgtccctgagccgctatataagcgcggcagggaacatccggaggggctgaagatgaaggtgcccgcgcatgggcccccgctgattgccagtccctcccgaccccgcgccccgcgcggagcccgaggccgccgaggacccgccttcgccgcagtagcagctggagcagcgacagaggcggcagctgcggcggcggcggcgcccgcgcccctcgcgccagcgcgtagagcggcggcggcagctcgggggccgccactgccccggctgccatgagttgtgcggaggtgatgtatcacccccagccttatggagcgtcccagtatctgcccaaccccatggcagcgacaacctgccccacagcctactatcagccggcgccccaacctggccagcagggagacattgggtcagtagtggatgaacacttctcaagagctttgggccaagccatcaccctccatccagaatctgccatttcaaaaagcaagatggggctaacccccctatggcgagacagctcagctctctcaagccagcggaatagtttcccaacttccttttggaccagctcttaccagcccccacctgcaccttgtttggggggagttcatcctgacttccaggtcactggaccccctggcaccttttctgcagctgatcccagtccttggccgggacacaacctgcatcagactggcccagcccctccccctgctgtgtctgagtcctggccttatcctttgacatctcaggtgagcccatcctacagccatatgcatgacgtgtacatgcggcaccaccaccctcatgcccacatgcaccaccgccaccgccaccatcatcaccatcaccaccctcctgctggctctgccctggatccatcctatgggcctctgctgatgccttcagtgcatgcggccaggattcctgctccccagtgtgacatcacaaagacagaaccaactacagtcacctctgctacctcagcatgggctggagcctttcatggaacagtagacatagtgcccagcgtgggattcgatacaggtctacagcatcaagacaagagtaaggaatcaccgtggtactgaaacacacaatcttagtgagttaagttgcagcataaatccaagggcccactgggaaaagatactgtcgggtttttccattcagcaataggacacgaaaggcatagaaggagaagacaaagtgtcacgcagttgactggttttcggcctttcttgagaaagcaaagtgggtcccagacattgaagaaaagcatttttatttgtttatttcctcatctgagcctttgccaactgtgcaactctctccttttgttatcttgcttttatcaatatatagctaagtttttgtttcattttgatttttttttttagccaaccaccttgtcaggaaaggatggaaccacacattaaaatgttcattctttcaggaatacaagtttgtagctctatgtgcatctatttttgtagaaatacaaaaagtttggtttagcattgatgggctatttttgagggatgtattttttttaaaattgtaaaaattgttgagttctgtttaaagaacttgctctcagagaagcactggcaaaaatgtttaaaatgcttatctctaagatgtctattatatgctctgtctgtgctttctaggttacctcaaatgttttgtttttttccttcttacaaaagtagctataccgtagtcaaaccaatgcagtattgtttttacattgaatctcagtaaagatttaattccatgctagctcaattagttttgaattatatgtatagcttgaaaagtttttttttaatgactgtgctaaagaaatgatattttattgctttgatttctcccaaagaataacttggaggttgactaataagaaagttggcataaactttcaatcaaatgaagagtttgcctagaggagactaattctctttctagcccatccaaatttgataaatggaaccagaggttatatacaactacaaggaaaaaaatgcatttaaccatgccacctatgagtgccagtgacttattttacttgtttttaattattcattcatggcaatttaaaaagtcatattttaagtgggatttgtttttcctgaagggcatttgaaggaacaatatctgggaaggtactagagaaattacaaagcccgagctctttcttataatgccacctatccctgtaagctaaacaaacaaacaaacaaacaaacaaacagttctatatataatagtttcaacacagaacttaacaagtctctttttttgtttgtttaaatctggctttacttgatttaattcctttttagaaagaaatttagggcaaaataaagtgtatattaggatttaaatttatgccacaatttaaaaataaaaccagagg

SEQ ID NO: 30175 - DNA, 1450 bp, Homo sapiens
ggctgtggctgtgactggcgctgccgtgggcgccgcagccctcgcgggagccggacgcggtaatgccccagcggcgcagcgggcggctgcgtccctgagccgctatataagcgcggcagggaacatccggaggggctgaagatgaaggtgcccgcgcatgggcccccgctgattgccagtccctcccgaccccgcgccccgcgcggagcccgaggccgccgaggacccgccttcgccgcagtagcagctggagcagcgacagaggcggcagctgcggcggcggcggcgcccgcgcccctcgcgccagcgcgtagagcggcggcggcagctcgggggccgccactgccccggctgccatgagttgtgcggaggtgatgtatcacccccagccttatggagcgtcccagtatctgcccaaccccatggcagcgacaacctgccccacagcctactatcagccggcgccccaacctggccagcagaagaagttagcggtattcagcaagatgcaggactctctggaagtcacccttcccagcaaacaagaggaggaggatgaggaggaggaggaggaggagaaagaccagcctgccgagatggagtaccttaactctcgctgtgtccttttcacttatttccagggagacattgggtcagtagtggatgaacacttctcaagagctttgggccaagccatcaccctccatccagaatctgccatttcaaaaagcaagatggggctaacccccctatggcgagacagctcagctctctcaagccagcggaatagtttcccaacttccttttggaccagctcttaccagcccccacctgcaccttgtttggggggagttcatcctgacttccaggtcactggaccccctggcaccttttctgcagctgatcccagtccttggccgggacacaacctgcatcagactggcccagcccctccccctgctgtgtctgagtcctggccttatcctttgacatctcaggtgagcccatcctacagccatatgcatgacgtgtacatgcggcaccaccaccctcatgcccacatgcaccaccgccaccgccaccatcatcaccatcaccaccctcctgctggctctgccctggatccatcctatgggcctctgctgatgccttcagtgcatgcggccaggattcctgctccccagtgtgacatcacaaagacagaaccaactacagtcacctctgctacctcagcatgggctggagcctttcatggaacagtagacatagtgcccagcgtgggattcgatacaggtctacagcatcaagacaagagtaaggaatcaccgtggtactgaaacacacaatcttagtgaagaagctgctctccaagtgaatacagctcaatgcaactcaacaagtgtttgcagagcacctgctgaaagtcaaggagaagccttactcacttcca

SEQ ID NO: 30176 - DNA, 425 bp, Homo sapiens
agtggacaattagaggcaagtctatcccaaaactgagtcttatgttaataatgttttttattttctgtcttctcagacagctcagctctctcaagccagcggaatagtttcccaacttccttttggaccagctcttaccagcccccacctgcaccttgtttggggggagttcatcctgacttccaggtcactggaccccctggcaccttttctgcagctgatcccagtccttggccgggacacaacctgcatcagactggcccagcccctccccctgctgtgtctgagtcctggccttatcctttgacatctcaggtgagcccatcctacagccatatgcatgacgtgtacatgcggcaccaccaccctcatgcccacatgcaccaccgccaccgccaccatcatcaccatcaccaccctcctgc

SEQ ID NO: 30177 - DNA, 385 bp, Homo sapiens
tccatctctgcaaaaaaataaaaataaattagccaggtgtggtggctgtgcccggaatctcagctacttgggaggctgaggtgggaggatcacttgagcctgggcggtcaaggctgcagtgagccttgattgcaccactgcactccagcctgggtgatggagcaagatcctgtttcaaaaaaaaaaaaaaaaaataggaaaaggaaaaggaaagaaagaaagaaagaaattctcttaaaatttttttaaaattataaatattaaaataagaaggcaaatagactaagaaaaaatcagtaaaagcgacaaattgtcatgtttatattatctttacaatataaaacgtcagttcaagtcaatttttaaatgatattgaaatattact

SEQ ID NO: 30178 - DNA, 400 bp, Homo sapiens
gacaagcacgccagccattggctcataatgagctgaaagaccaatgactgcttctcagagactccctagggcccagtgtcctgggggcagacctgtggctgagtcagcatggtgcacagcagaaagtggggggagagtggccagcgctgccccggcgggctctgtctgcatcacctggagcggcacagacccttcagtctccattctctcttcaggaaagaggcctactcgcagatgaacgcaccaaggctcagagacaaagcaaatccgtgggatgccgagggcacttggataacttccgctcgggagagaagcccaaactccgcgtcccggagacctgaagtgtggccgccagtggacacccagctgagggatgagcaggtgggcctcagtggtggct

SEQ ID NO: 30179 - DNA, 1149 bp, Homo sapiens
gcgggaaaagttcagctgagagatataaaagagcagtctttccagcacctgcaaatccagagcggcgggcactgacgggcacttgcaccgtgtggacagactctccggttctggggaaatccagtccctgttactccattttggccagaaattcaagacatttcaggtggcagaataaattcaatccttgtttctccatcttatcgagtagtagaagttagttacattctctttgaactcatcatgaattccatgaagactgaagaaaacaagtcatttagcgctatggaagatgaccagaggactagacctgaagtttcaaaggatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcctgcctagtgattctcattttaaaattacatttggtcaaagaaagagtagcaaagaagatggacacatattacgccaatgtgaaaatccaaacatggaatgcattctttttcatgttgttgctataggaaggacaagaaagaagattgttaagatcaacgaacttcatgaaaaaggaagtaaactttgtatttatgccttgaagggtgagactattgaaggagccttatgcaaggatggccgttttcggtctgacataggtgaatttgaatggaaactaaaggaaggtcataagaaaatttatggaaaacagtccatggtggatgaagtatctggaaaagtcttagaaatggacatttcaaaaaaaaaagcattacaacagaaagatatccataaaaaaattaaacagaatgaaagtgccactgatgaaattaatcaccagagtctgatacagtctaag

SEQ ID NO: 30180 - DNA, 982 bp, Homo sapiens
gcgggaaaagttcagctgagagatataaaagagcagtctttccagcacctgcaaatccagagcggcgggcactgacgggcacttgcaccgtgtggacagactctccggttctggggaaatccagtccctgttactccattttggccagaaattcaaggatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcctgcctagtgattctcattttaaaattacatttggtcaaagaaagagtagcaaagaagatggacacatattacgccaatgtgaaaatccaaacatggaatgcattctttttcatgttgttgctataggaaggacaagaaagaagattgttaagatcaacgaacttcatgaaaaaggaagtaaactttgtatttatgccttgaagggtgagactattgaaggagccttatgcaaggatggccgttttcggtctgacataggtgaatttgaatggaaactaaaggaaggtcataagaaaatttatggaaaacagtccatggtggatgaagtatctggaaaagtcttagaaatggacatttcaaaaaaaaaagcattacaacagaaagatatccataaaaaaattaaacagaatgaaagtgccactgatgaaattaatcaccagagtctgatacagtctaag

SEQ ID NO: 30181 - DNA, 1218 bp, Homo sapiens
gaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggcaaactgacgacaaaaaaaagattctttataaagatgatatggtaacatgtatcttgccctggagtctgggtgggtccagtcagtctcagatttacaagcatttaggagcctaggtaaaagctgctagtattcttttaaaagttacatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaatt

SEQ ID NO: 30182 - DNA, 285 bp, Homo sapiens
ctgaatcgaacttttcttagttgatgagtgttttaagtgtcagtttacagtgaaatcctgtgatgatacaaaatttagatatagtataattgactctcatcctctgccatgcctattgtctgcaggtgagggccaggctgacatttcatttttaatcattgacttaatattcagtaagtaaacctgatatgtgaacttttctctccctttcctttctattctgtaactggaagactaatggaaaaatacagttttctgttaactttgcaataagccctgtgtttc

SEQ ID NO: 30183 - DNA, 483 bp, Homo sapiens
gcatgccactccaaaagtcagtgacttaaaacaaccactatttatctctcttatgtatctgctggttggctgatctaggttgggcttgacactaggccacagatttggtccaggtctgttccacttgcctctcattattgttggagtaacgggctacccagggcatgcccttagcatgctaagacggacaagcaagagggcaagcccactcgcaagcatatgtcaagcctttacttgagtcgtatcaaccaacattctattggctaaagtaatcatgtggccacattccacataagtaaatgaagcagagaaataggctccagttttagtgggaggaactctgaaatcacagtgcaaagggcacagctgcaggggaagatgagggattggtaacaaggatacattctcccatgttggaaaaaaggaaactgatgagaggtgataaaagaatttccgtcgagtttctattttctgtgactgcat

SEQ ID NO: 30184 - DNA, 487 bp, Homo sapiens
tcatataacataaaattaactattttaaagtgtacaattcagtggtgtttagtacgttcacaaatttgtggaaccactacctctatctagtcctaaaacatttttgtcaccccgaacgataactgtacccattagcagtcactcccaactcctcccttgccccagcccctggctaccactcacctttctctctatatagatgtgcccattctggatatttcatataagtgaaatcgtacactgtgtggctggaatcgcacactgtgcggctggactcatgcactgtgcggctggagtcgtgcaccgtgtggctggactcgtgcactgtggctggagtcgtacactgtgcagctggagtcgtgcgctgtgtggatggaatcatacactgtgtggcttcttgtgcctggtttcttttactcagtgtcaaaagttcatccatgtggcatgtatcaatacttcattcctttttatggccgaattatgttcc

SEQ ID NO: 30185 - DNA, 334 bp, Homo sapiens
tctacttgatatccatcaagcatattatatctgcaaatgtatatctatcatcaaacttggaaaatataaaagtttcttaaataattttttctcaattttcttttttctactattataattacacatttgttgcactgagatcaagataatcaaacaagcccctaagtctctgttcatctttttaaatttttttcttactgttttacatcttatataattttagttgatttatcttactttactctgtcatgcttattcagttatcaattccaatctaggaaaattcctttactttagaaatttgatttttagttctagaaaaactaattaattc

SEQ ID NO: 30186 - DNA, 3169 bp, Homo sapiens
caacaccgactgtcatgcaaataatacatttaaaatagttgcatggtttcaaagacaatgcagacgtaattggcctttgactttgggacctcgggttactctcactccctactgcaaaacaaactaagggttgaaagcaaagcattctgttcaaatccagggccctttgtttgaaaagaacacagggcccacagctggtgttttgaagtagaagttcccactagtggcgcagtggaccgtctgatgctgacttgcaggaagtcggtcctgggaggctctgaacacccctccctgtgattaaccactttgctgtcagaaatgtcattttcccatacactgtgctgtgggcccggggcctccttcgcttctttctttgggttccatatgttgcccgatcttgaggttagcgctcgccccaatttctccatgagtttactctgagttgacaggcgatgatctgacagttggaggtgtctgggtgtttggaggtggccccgttctcatgttggctgctcatcagacattgagtttggccccggcggttctactacgtcactacctggaagcaattgcctttaacactctgctgtttggggtttcgatgctttttatgctgcgttgcgtgctttcattccggaagagctaagtgtcctttgcagtctctctgagaatgttttgtaattctgccgccacgctgttctgtgcggaccgacctcaagaggcttgggcccccgtgggtgtcccactgcctgccggcccagggtacaggctgcttgggtccgctgggctggccttgggctgtcagaatctggtccagggtgtttcgaggggacactgcacagccgctcgcccctcgactcagtcatgggagctgcagcacgcagatccaccgcaagcttcctgcacgcgcatctccggaatgctgcgctgggccctcccaccatcttcgcgtttgtgagaatttactcagaagtgagagaactgaagattcctggtgcttttgttaacacgtttctatcttattggttggtgtggaaatgttagatgtgttgttaggtttttaaatgctgtgggtggtatgattaaagggttaagtcctcacctcagcccccagcccccttttggggggtaggaagaggctgagttatctcctatttaaaacctccttggatttaagtagttcagagttaaagctaaaacaccaaatattaactctttcccccaagtgtctccaggaactggacgttggggccattcttattcagttctttctgtagctccaaggtccttaaaatgagtgagttgatcccaagaacaccccacagcaccaaccagcagggcacagtgcaagcgacttcatagatcggggtgctcgtgtaggggtccggggctcctttgaactctgggagttgtgtgcgcagtcttgggtgggagacggcaggtccctctgtcccaagaagctggtggtgccaaggccttcctctgtctccatcagtgccagcctgatcgcgttctggaagacccagtctcagactctgtgcctttaaagtccggtcctcagtgtcctttcagaatcatgttggggctgcgtttctctggggaactaagcctgtgccattccacaaggcaggcgtggacctccagccttggaagctttctttccgctcctcagcccctgacttgtaaactgtgatgccatgcagtctggagccgcgggggacgcactcggtctcattgcggaaaacacttggttccagtcgtgtggtttctcccataccctgaccaagtccacctctgccaggattgcaggagattggtgcaagacccatctcttatgcattgaccatgaccatcagcaaagcctggtggtcttgttctcatagtcactcgagaagaatatttattgtaatggaagtagattttttaaaaaaggaattggaatcatgtctttgtagaatgtgtgtgtgtgaagtcctcagctgtaaggtgctattcagtcctgtgacccttattttggaatgctcttcattactgttgctctgttttgtgacttcctgggaaaccgcctactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcgtgactcaaaccctacagtatggagggtggcgttgcattgaaattccaggcctgagtttgatagtggattttaatgtagttgttaaaggtatgaattcatgttttataactgtagaggcaagcaagtttttattttttaaaaagttttgagagaataatttataagtttctgtgcagcaaagtggctaattactcattaaatacaggaaaagaatgtagtatctaaatccagctttttcttacctctggtacacttcagattacttacctaatacatattgagggcttttaacccttagttttatcaatttttctagttttattttatttttataaaataattgaaaaagaaccaaaaatgaattcagaagttccatagatggatttttgccccttcttaattttctcccacaatgaaaacattttagaagacattttgaatcaaaatgtattatgaccattgaaagttctctattttctaagaagctgagcagctccaagggcctcgtttcaggtggtactctatgtattgtctgtgggcttgtttctacctgtacagtggaaccatgtgaccatgtcttgtgcttgcaatatagaaaccatgcagtgctgttttgtgaattggcagtttctgtataaactcttatttatatacattggcctctctgtatgattttccatttgctacatgaattgtaaaattaattataaaattatagtacctgctaaatac

SEQ ID NO: 30187 - DNA, 427 bp, Homo sapiens
ccccccccaaaaaaaaaaaagagggggagtgttttattttacaataaaactggtgaagaaagctaaatgctgagaaactgagcatctattgtcgtgtttaagcttagctgggtcctttctagtttgtttttacagcttactaggtgaagtagtttgcactatttttgcaataaattcatggaaaacctaacagttacttgttttgtttcttactgtgtgtatataaactaatactaaaagtttggcatagtgttttttcacctccttacataacccctaacatgcacagaatgctgtaaatctgataaaatatgatgtgaatgatattttataaagttattttgtatggtgtcaattttgttttgcctcatagtatgtcagcaaaaaattaaataaaagtcctcctatttacagctgcttccaaaaa

SEQ ID NO: 30188 - DNA, 422 bp, Homo sapiens
gcggccgcccctcggccccggagcccctcggcggcgccaccatgtactcgggagccggccccgggacaaaggaattaatagagtaacacgggtaaaaaatgcagagaaagcaaaggaagatgccaagagtgatgagaggggtgacttggaacaaatctgtgtgtggaggtgtctgagctcttgggagtggctgggggctcatgtgacgttgcaggatgcccgcctcagcataacagcaccctgagcgcaggctcaggtcaggcccacctcactggaatcctggccacgtgatgggtgtctcacctcacctctctgaacctcagtctcctcttcgtacagagtgaaaacctcgtcctcatggtggtggtgctttgatcagaggagatgatgcgggcgacctgcagttgtgtcccacatgcagg

SEQ ID NO: 30189 - DNA, 423 bp, Homo sapiens
gcggccgcccctcggccccggagcccctcggcggcgccaccatgtactcgggagccggccccgcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcactttaaaacacagatctttggggatcggaagcccgtgtttgacggcaggaagaatctatacacagccatgccccttccgattgggagggacaaggtccagacacggatatcgagaacttgctgaaaccaccaaactttaa

SEQ ID NO: 30190 - DNA, 5967 bp, Homo sapiens
caacaccgactgtcatgcaaataatacatttaaaatagttgcatggtttcaaagacaatgcagacgtaattggcctttgactttgggacctcgggttactctcactccctactgcaaaacaaactaagggttgaaagcaaagcattctgttcaaatccagggccctttgtttgaaaagaacacagggcccacagctggtgttttgaagtagaagttcccactagtggcgcagtggaccgtctgatgctgacttgcaggaagtcggtcctgggaggctctgaacacccctccctgtgattaaccactttgctgtcagaaatgtcattttcccatacactgtgctgtgggcccggggcctccttcgcttctttctttgggttccatatgttgcccgatcttgaggttagcgctcgccccaatttctccatgagtttactctgagttgacaggcgatgatctgacagttggaggtgtctgggtgtttggaggtggccccgttctcatgttggctgctcatcagacattgagtttggccccggcggttctactacgtcactacctggaagcaattgcctttaacactctgctgtttggggtttcgatgctttttatgctgcgttgcgtgctttcattccggaagagctaagtgtcctttgcagtctctctgagaatgttttgtaattctgccgccacgctgttctgtgcggaccgacctcaagaggcttgggcccccgtgggtgtcccactgcctgccggcccagggtacaggctgcttgggtccgctgggctggccttgggctgtcagaatctggtccagggtgtttcgaggggacactgcacagccgctcgcccctcgactcagtcatgggagctgcagcacgcagatccaccgcaagcttcctgcacgcgcatctccggaatgctgcgctgggccctcccaccatcttcgcgtttgtgagaatttactcagaagtgagagaactgaagattcctggtgcttttgttaacacgtttctatcttattggttggtgtggaaatgttagatgtgttgttaggtttttaaatgctgtgggtggtatgattaaagggttaagtcctcacctcagcccccagcccccttttggggggtaggaagaggctgagttatctcctatttaaaacctccttggatttaagtagttcagagttaaagctaaaacaccaaatattaactctttcccccaagtgtctccaggaactggacgttggggccattcttattcagttctttctgtagctccaaggtccttaaaatgagtgagttgatcccaagaacaccccacagcaccaaccagcagggcacagtgcaagcgacttcatagatcggggtgctcgtgtaggggtccggggctcctttgaactctgggagttgtgtgcgcagtcttgggtgggagacggcaggtccctctgtcccaagaagctggtggtgccaaggccttcctctgtctccatcagtgccagcctgatcgcgttctggaagacccagtctcagactctgtgcctttaaagtccggtcctcagtgtcctttcagaatcatgttggggctgcgtttctctggggaactaagcctgtgccattccacaaggcaggcgtggacctccagccttggaagctttctttccgctcctcagcccctgacttgtaaactgtgatgccatgcagtctggagccgcgggggacgcactcggtctcattgcggaaaacacttggttccagtcgtgtggtttctcccataccctgaccaagtccacctctgccaggattgcaggagattggtgcaagacccatctcttatgcattgaccatgaccatcagcaaagcctggtggtcttgttctcatagtcactcgagaagaatatttattgtaatggaagtagattttttaaaaaaggaattggaatcatgtctttgtagaatgtgtgtgtgtgaagtcctcagctgtaaggtgctattcagtcctgtgacccttattttggaatgctcttcattactgttgctctgttttgtgacttcctgggaaaccgcctactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcgtgactcaaaccctacagtatggagggtggcgttgcattgaaattccaggcctgagtttgatagtggattttaatgtagttgttaaaggtatgaattcatgttttataactgtagaggcaagcaagtttttattttttaaaaagttttgagagaataatttataagtttctgtgcagcaaagtggctaattactcattaaatacaggaaaagaatgtagtatctaaatccagctttttcttacctctggtacacttcagattacttacctaatacatattgagggcttttaacccttagttttatcaatttttctagttttattttatttttataaaataattgaaaaagaaccaaaaatgaattcagaagttccatagatggatttttgccccttcttaattttctcccacaatgaaaacattttagaagacattttgaatcaaaatgtattatgaccattgaaagttctctattttctaagaagctgagcagctccaagggcctcgtttcaggtggtactctatgtattgtctgtgggcttgtttctacctgtacagtggaaccatgtgaccatgtcttgtgcttgcaatatagaaaccatgcagtgctgttttgtgaattggcagtttctgtataaactcttatttatatacattggcctctctgtatgattttccatttgctacatgaattgtaaaattaattataaaattatagtacctgctaaatacaattctgaggcttcatgtcattgtctttagttgaataccatgctgtgtgtcttgaagatgtccacgcttgcatgatgctaggtggcaatgccactttaaattaagccttaatcagatgttaaatttgtgagtttcagagtatgcaaaaatattaggcagagtgagtgtaaactgttcagatcaagatgctgtatcataattcaagttatttttttctggagttaaagggaagcattcagtgatacacctctctctctctctctctctctctcttgtctagcttggctatggccatagcttgatgaaaatggaccattgtgcatttctgtgacagtcaaaaagacctgttctaaaagtcttgcgactttttcagggttttttttttttttcatgtttctttttttttttcccctccagtctgagatttctgtgtggctgatggagagtgtgatttgggcgtaggtcttatttgcaaacctgctcatgttctaagctttcttcaggtagtaccacctgtcatcgcttctgcatatgatttaaatggatttttgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcccccctgtgaaaagaaaaaaaaaatgtccaagagcaaatttaacattttacaaacaataaagtccaaactcctctatgcacatatttatagcttatcacttcattttctgtgccagtgaaggggtggccagaaaaaaaatcccaagtaccctcatcattgcttttctagccattcatgccccctcttcctctggcacattttctaagagtttatttcataagcagcaaacggactgttgtcgatttcatctctcctgacctacctggtggaggtgctaatggccatggacagaaaggggcgagccagagctcgtggctttgtggaggcagaggcctgcattcagcagcggccctgtgtgcctgtaagttaggaaggctttctgacaggtaagaaaatgagataggttgatgacttaccatgcttttatatttggcagtttacaattctagacttttcctactatggcgatctttttttacttaattctttggaggtaacaatattttggagtcttaagaatttgattttataccaataagaaataaaaattagggatctttcctgtagtatatagttttactattttaaagagatctctgaattttacaagagaaccaacattccttaatggcagaactttgaaagttgatttgggaggctttttgctgcaggatctcaaaaatagagagagagatgattctacttaaatgtttttaattttctaacttccatcaggttgatacttaagctctattttgtaaagagtaaatcatcctttagtatgctgcataagatgatcagcattcttgcactttctcagtaataagacgtgccgggcaattggctccccaggacgcattgtgtttttaacctaacgagaggactttggggcaggtgattaaatttatataggtacctcaagaaaaagaacctgaatatgctgcattttctttctttagcttttacatgtagcattttgttttgcttttgttatttttgttttgatatatgctttttggaccccaatagactgttgaaagaaatttaaaaattactcttgtagggatatagtatccttaaaaaataaaaattaaaaaaaatttaaaaaaattgctgcaatatctggctcgaaggttgccctatattagaataatactttagccaaatacacctgaggaggcagacactgtgtttataagcagacaataatgttctgaatccttcctgttcatgctgctttcttaattcatttctccatgtcatcaagaggttggataacttatttctaagctcaaggttaaaaatcatgtcaccttttttttttttcccccaacacagacctcagaaaaattgcgattgaggaagtagcatgatcctaaatgtgttgctgaaatcaggcagcccgagcctctggtctctccagagagcccgtcttcacatttctctattcctcagcactcacccgaaactgaacagatggggagtggtcttgattgtcaagataaaactggtgaagaaagctaaatgctgagaaactgagcatctattgtcgtgtttaagcttagctgggtcctttctagtttgtttttacagcttactaggtgaagtagtttgcactatttttgcaataaattcatggaaaacctaacagttacttgttttgtttcttactgtgtgtatataaactaatactaaaagtttggcatagtgttttttcacctccttacataacccctaacatgcacagaatgctgtaaatctgataaaatatgatgtgaatgatattttataaagttattttgtatggtgtcaattttgttttgcctcatagtatgtcagcaaaaaattaaataaaagtcctcctatttacagctgcttccaaaaa

SEQ ID NO: 30191 - DNA, 4712 bp, Homo sapiens
gcggccgcccctcggccccggagcccctcggcggcgccaccatgtactcgggagccggccccgcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcactttaaaacacagatctttggggatcggaagcccgtgtttgacggcaggaagaatctatacacagccatgccccttccgattgggagggacaaggtggacctccagccttggaagctttctttccgctcctcagcccctgacttgtaaactgtgatgccatgcagtctggagccgcgggggacgcactcggtctcattgcggaaaacacttggttccagtcgtgtggtttctcccataccctgaccaagtccacctctgccaggattgcaggagattggtgcaagacccatctcttatgcattgaccatgaccatcagcaaagcctggtggtcttgttctcatagtcactcgagaagaatatttattgtaatggaagtagattttttaaaaaaggaattggaatcatgtctttgtagaatgtgtgtgtgtgaagtcctcagctgtaaggtgctattcagtcctgtgacccttattttggaatgctcttcattactgttgctctgttttgtgacttcctgggaaaccgcctactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcgtgactcaaaccctacagtatggagggtggcgttgcattgaaattccaggcctgagtttgatagtggattttaatgtagttgttaaaggtatgaattcatgttttataactgtagaggcaagcaagtttttattttttaaaaagttttgagagaataatttataagtttctgtgcagcaaagtggctaattactcattaaatacaggaaaagaatgtagtatctaaatccagctttttcttacctctggtacacttcagattacttacctaatacatattgagggcttttaacccttagttttatcaatttttctagttttattttatttttataaaataattgaaaaagaaccaaaaatgaattcagaagttccatagatggatttttgccccttcttaattttctcccacaatgaaaacattttagaagacattttgaatcaaaatgtattatgaccattgaaagttctctattttctaagaagctgagcagctccaagggcctcgtttcaggtggtactctatgtattgtctgtgggcttgtttctacctgtacagtggaaccatgtgaccatgtcttgtgcttgcaatatagaaaccatgcagtgctgttttgtgaattggcagtttctgtataaactcttatttatatacattggcctctctgtatgattttccatttgctacatgaattgtaaaattaattataaaattatagtacctgctaaatacaattctgaggcttcatgtcattgtctttagttgaataccatgctgtgtgtcttgaagatgtccacgcttgcatgatgctaggtggcaatgccactttaaattaagccttaatcagatgttaaatttgtgagtttcagagtatgcaaaaatattaggcagagtgagtgtaaactgttcagatcaagatgctgtatcataattcaagttatttttttctggagttaaagggaagcattcagtgatacacctctctctctctctctctctctctcttgtctagcttggctatggccatagcttgatgaaaatggaccattgtgcatttctgtgacagtcaaaaagacctgttctaaaagtcttgcgactttttcagggttttttttttttttcatgtttctttttttttttcccctccagtctgagatttctgtgtggctgatggagagtgtgatttgggcgtaggtcttatttgcaaacctgctcatgttctaagctttcttcaggtagtaccacctgtcatcgcttctgcatatgatttaaatggatttttgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcccccctgtgaaaagaaaaaaaaaatgtccaagagcaaatttaacattttacaaacaataaagtccaaactcctctatgcacatatttatagcttatcacttcattttctgtgccagtgaaggggtggccagaaaaaaaatcccaagtaccctcatcattgcttttctagccattcatgccccctcttcctctggcacattttctaagagtttatttcataagcagcaaacggactgttgtcgatttcatctctcctgacctacctggtggaggtgctaatggccatggacagaaaggggcgagccagagctcgtggctttgtggaggcagaggcctgcattcagcagcggccctgtgtgcctgtaagttaggaaggctttctgacaggtaagaaaatgagataggttgatgacttaccatgcttttatatttggcagtttacaattctagacttttcctactatggcgatctttttttacttaattctttggaggtaacaatattttggagtcttaagaatttgattttataccaataagaaataaaaattagggatctttcctgtagtatatagttttactattttaaagagatctctgaattttacaagagaaccaacattccttaatggcagaactttgaaagttgatttgggaggctttttgctgcaggatctcaaaaatagagagagagatgattctacttaaatgtttttaattttctaacttccatcaggttgatacttaagctctattttgtaaagagtaaatcatcctttagtatgctgcataagatgatcagcattcttgcactttctcagtaataagacgtgccgggcaattggctccccaggacgcattgtgtttttaacctaacgagaggactttggggcaggtgattaaatttatataggtacctcaagaaaaagaacctgaatatgctgcattttctttctttagcttttacatgtagcattttgttttgcttttgttatttttgttttgatatatgctttttggaccccaatagactgttgaaagaaatttaaaaattactcttgtagggatatagtatccttaaaaaataaaaattaaaaaaaatttaaaaaaattgctgcaatatctggctcgaaggttgccctatattagaataatactttagccaaatacacctgaggaggcagacactgtgtttataagcagacaataatgttctgaatccttcctgttcatgctgctttcttaattcatttctccatgtcatcaagaggttggataacttatttctaagctcaaggttaaaaatcatgtcaccttttttttttttcccccaacacagacctcagaaaaattgcgattgaggaagtagcatgatcctaaatgtgttgctgaaatcaggcagcccgagcctctggtctctccagagagcccgtcttcacatttctctattcctcagcactcacccgaaactgaacagatggggagtggtcttgattgtcaagataaaactggtgaagaaagctaaatgctgagaaactgagcatctattgtcgtgtttaagcttagctgggtcctttctagtttgtttttacagcttactaggtgaagtagtttgcactatttttgcaataaattcatggaaaacctaacagttacttgttttgtttcttactgtgtgtatataaactaatactaaaagtttggcatagtgttttttcacctccttacataacccctaacatgcacagaatgctgtaaatctgataaaatatgatgtgaatgatattttataaagttattttgtatggtgtcaattttgttttgcctcatagtatgtcagcaaaaaattaaataaaagtcctcctatttacagctgcttccaaaaa

SEQ ID NO: 30192 - DNA, 4741 bp, Homo sapiens
agcttcatcccaccgggcaattttcctgcacagcagctgttacagtcccattctcacctggcccctgggccagttcggaagcctctgagcagcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcactttaaaacacagatctttggggatcggaagcccgtgtttgacggcaggaagaatctatacacagccatgccccttccgattgggagggacaaggtggacctccagccttggaagctttctttccgctcctcagcccctgacttgtaaactgtgatgccatgcagtctggagccgcgggggacgcactcggtctcattgcggaaaacacttggttccagtcgtgtggtttctcccataccctgaccaagtccacctctgccaggattgcaggagattggtgcaagacccatctcttatgcattgaccatgaccatcagcaaagcctggtggtcttgttctcatagtcactcgagaagaatatttattgtaatggaagtagattttttaaaaaaggaattggaatcatgtctttgtagaatgtgtgtgtgtgaagtcctcagctgtaaggtgctattcagtcctgtgacccttattttggaatgctcttcattactgttgctctgttttgtgacttcctgggaaaccgcctactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcgtgactcaaaccctacagtatggagggtggcgttgcattgaaattccaggcctgagtttgatagtggattttaatgtagttgttaaaggtatgaattcatgttttataactgtagaggcaagcaagtttttattttttaaaaagttttgagagaataatttataagtttctgtgcagcaaagtggctaattactcattaaatacaggaaaagaatgtagtatctaaatccagctttttcttacctctggtacacttcagattacttacctaatacatattgagggcttttaacccttagttttatcaatttttctagttttattttatttttataaaataattgaaaaagaaccaaaaatgaattcagaagttccatagatggatttttgccccttcttaattttctcccacaatgaaaacattttagaagacattttgaatcaaaatgtattatgaccattgaaagttctctattttctaagaagctgagcagctccaagggcctcgtttcaggtggtactctatgtattgtctgtgggcttgtttctacctgtacagtggaaccatgtgaccatgtcttgtgcttgcaatatagaaaccatgcagtgctgttttgtgaattggcagtttctgtataaactcttatttatatacattggcctctctgtatgattttccatttgctacatgaattgtaaaattaattataaaattatagtacctgctaaatacaattctgaggcttcatgtcattgtctttagttgaataccatgctgtgtgtcttgaagatgtccacgcttgcatgatgctaggtggcaatgccactttaaattaagccttaatcagatgttaaatttgtgagtttcagagtatgcaaaaatattaggcagagtgagtgtaaactgttcagatcaagatgctgtatcataattcaagttatttttttctggagttaaagggaagcattcagtgatacacctctctctctctctctctctctctcttgtctagcttggctatggccatagcttgatgaaaatggaccattgtgcatttctgtgacagtcaaaaagacctgttctaaaagtcttgcgactttttcagggttttttttttttttcatgtttctttttttttttcccctccagtctgagatttctgtgtggctgatggagagtgtgatttgggcgtaggtcttatttgcaaacctgctcatgttctaagctttcttcaggtagtaccacctgtcatcgcttctgcatatgatttaaatggatttttgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcccccctgtgaaaagaaaaaaaaaatgtccaagagcaaatttaacattttacaaacaataaagtccaaactcctctatgcacatatttatagcttatcacttcattttctgtgccagtgaaggggtggccagaaaaaaaatcccaagtaccctcatcattgcttttctagccattcatgccccctcttcctctggcacattttctaagagtttatttcataagcagcaaacggactgttgtcgatttcatctctcctgacctacctggtggaggtgctaatggccatggacagaaaggggcgagccagagctcgtggctttgtggaggcagaggcctgcattcagcagcggccctgtgtgcctgtaagttaggaaggctttctgacaggtaagaaaatgagataggttgatgacttaccatgcttttatatttggcagtttacaattctagacttttcctactatggcgatctttttttacttaattctttggaggtaacaatattttggagtcttaagaatttgattttataccaataagaaataaaaattagggatctttcctgtagtatatagttttactattttaaagagatctctgaattttacaagagaaccaacattccttaatggcagaactttgaaagttgatttgggaggctttttgctgcaggatctcaaaaatagagagagagatgattctacttaaatgtttttaattttctaacttccatcaggttgatacttaagctctattttgtaaagagtaaatcatcctttagtatgctgcataagatgatcagcattcttgcactttctcagtaataagacgtgccgggcaattggctccccaggacgcattgtgtttttaacctaacgagaggactttggggcaggtgattaaatttatataggtacctcaagaaaaagaacctgaatatgctgcattttctttctttagcttttacatgtagcattttgttttgcttttgttatttttgttttgatatatgctttttggaccccaatagactgttgaaagaaatttaaaaattactcttgtagggatatagtatccttaaaaaataaaaattaaaaaaaatttaaaaaaattgctgcaatatctggctcgaaggttgccctatattagaataatactttagccaaatacacctgaggaggcagacactgtgtttataagcagacaataatgttctgaatccttcctgttcatgctgctttcttaattcatttctccatgtcatcaagaggttggataacttatttctaagctcaaggttaaaaatcatgtcaccttttttttttttcccccaacacagacctcagaaaaattgcgattgaggaagtagcatgatcctaaatgtgttgctgaaatcaggcagcccgagcctctggtctctccagagagcccgtcttcacatttctctattcctcagcactcacccgaaactgaacagatggggagtggtcttgattgtcaagataaaactggtgaagaaagctaaatgctgagaaactgagcatctattgtcgtgtttaagcttagctgggtcctttctagtttgtttttacagcttactaggtgaagtagtttgcactatttttgcaataaattcatggaaaacctaacagttacttgttttgtttcttactgtgtgtatataaactaatactaaaagtttggcatagtgttttttcacctccttacataacccctaacatgcacagaatgctgtaaatctgataaaatatgatgtgaatgatattttataaagttattttgtatggtgtcaattttgttttgcctcatagtatgtcagcaaaaaattaaataaaagtcctcctatttacagctgcttccaaaaa

SEQ ID NO: 30193 - DNA, 3192 bp, Homo sapiens
  misc_feature (4)..(4): n is a, c, g, or t
cctnctactactaaattcgcggccgcgtcgacttccatagatggatttttgccccttcttaattttctcccacaatgaaaacattttagaagacattttgaatcaaaatgtattatgaccattgaaagttctctattttctaagaagctgagcagctccaagggcctcgtttcaggtggtactctatgtattgtctgtgggcttgtttctacctgtacagtggaaccatgtgaccatgtcttgtgcttgcaatatagaaaccatgcagtgctgttttgtgaattggcagtttctgtataaactcttatttatatacattggcctctctgtatgattttccatttgctacatgaattgtaaaattaattataaaattatagtacctgctaaatacaattctgaggcttcatgtcattgtctttagttgaataccatgctgtgtgtcttgaagatgtccacgcttgcatgatgctaggtggcaatgccactttaaattaagccttaatcagatgttaaatttgtgagtttcagagtatgcaaaaatattaggcagagtgagtgtaaactgttcagatcaagatgctgtatcataattcaagttatttttttctggagttaaagggaagcattcagtgatacacctctctctctctctctctctctctcttgtctagcttggctatggccatagcttgatgaaaatggaccattgtgcatttctgtgacagtcaaaaagacctgttctaaaagtcttgcgactttttcagggttttttttttttttcatgtttctttttttttttcccctccagtctgagatttctgtgtggctgatggagagtgtgatttgggcgtaggtcttatttgcaaacctgctcatgttctaagctttcttcaggtagtaccacctgtcatcgcttctgcatatgatttaaatggatttttgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcccccctgtgaaaagaaaaaaaaaatgtccaagagcaaatttaacattttacaaacaataaagtccaaactcctctatgcacatatttatagcttatcacttcattttctgtgccagtgaaggggtggccagaaaaaaaatcccaagtaccctcatcattgcttttctagccattcatgccccctcttcctctggcacattttctaagagtttatttcataagcagcaaacggactgttgtcgatttcatctctcctgacctacctggtggaggtgctaatggccatggacagaaaggggcgagccagagctcgtggctttgtggaggcagaggcctgcattcagcagcggccctgtgtgcctgtaagttaggaaggctttctgacaggtaagaaaatgagataggttgatgacttaccatgcttttatatttggcagtttacaattctagacttttcctactatggcgatctttttttacttaattctttggaggtaacaatattttggagtcttaagaatttgattttataccaataagaaataaaaattagggatctttcctgtagtatatagttttactattttaaagagatctctgaattttacaagagaaccaacattccttaatggcagaactttgaaagttgatttgggaggctttttgctgcaggatctcaaaaatagagagagagatgattctacttaaatgtttttaattttctaacttccatcaggttgatacttaagctctattttgtaaagagtaaatcatcctttagtatgctgcataagatgatcagcattcttgcactttctcagtaataagacgtgccgggcaattggctccccaggacgcattgtgtttttaacctaacgagaggactttggggcaggtgattaaatttatataggtacctcaagaaaaagaacctgaatatgctgcattttctttctttagcttttacatgtagcattttgttttgcttttgttatttttgttttgatatatgctttttggaccccaatagactgttgaaagaaatttaaaaattactcttgtagggatatagtatccttaaaaaataaaaattaaaaaaaatttaaaaaaattgctgcaatatctggctcgaaggttgccctatattagaataatactttagccaaatacacctgaggaggcagacactgtgtttataagcagacaataatgttctgaatccttcctgttcatgctgctttcttaattcatttctccatgtcatcaagaggttggataacttatttctaagctcaaggttaaaaatcatgtcaccttttttttttttcccccaacacagacctcagaaaaattgcgattgaggaagtagcatgatcctaaatgtgttgctgaaatcaggcagcccgagcctctggtctctccagagagcccgtcttcacatttctctattcctcagcactcacccgaaactgaacagatggggagtggtcttgattgtcaagataaaactggtgaagaaagctaaatgctgagaaactgagcatctattgtcgtgtttaagcttagctgggtcctttctagtttgtttttacagcttactaggtgaagtagtttgcactatttttgcaataaattcatggaaaacctaacagttacttgttttgtttcttactgtgtgtatataaactaatactaaaagtttggcatagtgttttttcacctccttacataacccctaacatgcacagaatgctgtaaatctgataaaatatgatgtgaatgatattttataaagttattttgtatggtgtcaattttgttttgcctcatagtatgtcagcaaaaaattaaataaaagtcctcctatttacagctgcttccaaaaa

SEQ ID NO: 30194 - DNA, 3322 bp, Homo sapiens
gcggccgcccctcggccccggagcccctcggcggcgccaccatgtactcgggagccggccccgcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcactttaaaacacagatctttggggatcggaagcccgtgtttgacggcaggaagaatctatacacagccatgccccttccgattgggagggacaaggtggagctggaggtcacgctgccaggagaaggcaaggatcgcatcttcaaggtgtccatcaagtgggtgtcctgcgtgagcttgcaggcgttacacgatgcactttcagggcggctgcccagcgtcccttttgagacgatccaggccctggacgtggtcatgaggcacttgccatccatgaggtacacccccgtgggccgctccttcttcaccgcgtccgaaggctgctctaaccctcttggcgggggccgagaagtgtggtttggcttccatcagtccgtccggccttctctctggaaaatgatgctgaatattgatgtgtcagcaacagcgttttacaaaggcacagccagtaatcgagtttgtttgtgaagttttggattttaaaagtattgaagaacaacaaaaacctctgacagattcccaaagggtaaagtttaccaaagaaattaaaggtctaaaggtggagataacgcactgtgggcagatgaagaggaagtaccgcgtctgcaatgtgacccggcggcccgccagtcaccaaacattcccgctgcagcaggagagcgggcagacggtggagtgcacggtggcccagtatttcaaggacaggcacaagttggttctgcgctacccccacctcccatgtttacaagtcggacaggagcagaaacacacctaccttcccctggaggtctgtaacattgtggcaggacaaagatgtattaaaaaattaacggacaatcagacctcaaccatgatcagagcaactgctaggtcggcgcccgatcggcaagaagagattagcaaattgatgcgaagtgcaagtttcaacacagatccatacgtccgtgaatttggaatcatggtcaaagatgagatgacagacgtgactgggcgggtgctgcagccgccctccatcctctacgggggcaggaataaagctattgcgacccctgtccagggcgtctgggacatgcggaacaagcagttccacacgggcatcgagatcaaggtgtgggccattgcgtgcttcgccccccagcgccagtgcacggaagtccatctgaagtccttcacagagcagctcagaaagatctcgagagacgctggcatgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacgccgaggtcaagcgcgtgggagacacggtgctggggatggccacgcagtgcgtgcagatgaagaacgtgcagaggaccacgccacagaccctgtccaacctctgcctgaagatcaacgtcaagctgggaggcgtgaacaacatcctgctgccccagggcaggccgccggtgttccagcagcccgtcatctttctgggagcagacgtcactcacccccccgccggggatgggaagaagccctccattgccgccgtggtgggcagcatggacgcccaccccaatcgctactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaaacttggattttgaactgcagacctgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatgcagaggcgtccgcaggtgccgtgttctgccagcaccgcccttcacccggcctgaactaaggagcagtggcagaaggtgggccccgtgtgtttacagcatttccaggtccagagaggttggcagacaagtgccattttaataaaaaatgtattta

SEQ ID NO: 30195 - DNA, 2280 bp, Homo sapiens
  misc_feature (4)..(4): n is a, c, g, or t
cctnctactactaaattcgcggccgcgtcgacgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcccccctgtgaaaagaaaaaaaaaatgtccaagagcaaatttaacattttacaaacaataaagtccaaactcctctatgcacatatttatagcttatcacttcattttctgtgccagtgaaggggtggccagaaaaaaaatcccaagtaccctcatcattgcttttctagccattcatgccccctcttcctctggcacattttctaagagtttatttcataagcagcaaacggactgttgtcgatttcatctctcctgacctacctggtggaggtgctaatggccatggacagaaaggggcgagccagagctcgtggctttgtggaggcagaggcctgcattcagcagcggccctgtgtgcctgtaagttaggaaggctttctgacaggtaagaaaatgagataggttgatgacttaccatgcttttatatttggcagtttacaattctagacttttcctactatggcgatctttttttacttaattctttggaggtaacaatattttggagtcttaagaatttgattttataccaataagaaataaaaattagggatctttcctgtagtatatagttttactattttaaagagatctctgaattttacaagagaaccaacattccttaatggcagaactttgaaagttgatttgggaggctttttgctgcaggatctcaaaaatagagagagagatgattctacttaaatgtttttaattttctaacttccatcaggttgatacttaagctctattttgtaaagagtaaatcatcctttagtatgctgcataagatgatcagcattcttgcactttctcagtaataagacgtgccgggcaattggctccccaggacgcattgtgtttttaacctaacgagaggactttggggcaggtgattaaatttatataggtacctcaagaaaaagaacctgaatatgctgcattttctttctttagcttttacatgtagcattttgttttgcttttgttatttttgttttgatatatgctttttggaccccaatagactgttgaaagaaatttaaaaattactcttgtagggatatagtatccttaaaaaataaaaattaaaaaaaatttaaaaaaattgctgcaatatctggctcgaaggttgccctatattagaataatactttagccaaatacacctgaggaggcagacactgtgtttataagcagacaataatgttctgaatccttcctgttcatgctgctttcttaattcatttctccatgtcatcaagaggttggataacttatttctaagctcaaggttaaaaatcatgtcaccttttttttttttcccccaacacagacctcagaaaaattgcgattgaggaagtagcatgatcctaaatgtgttgctgaaatcaggcagcccgagcctctggtctctccagagagcccgtcttcacatttctctattcctcagcactcacccgaaactgaacagatggggagtggtcttgattgtcaagataaaactggtgaagaaagctaaatgctgagaaactgagcatctattgtcgtgtttaagcttagctgggtcctttctagtttgtttttacagcttactaggtgaagtagtttgcactatttttgcaataaattcatggaaaacctaacagttacttgttttgtttcttactgtgtgtatataaactaatactaaaagtttggcatagtgttttttcacctccttacataacccctaacatgcacagaatgctgtaaatctgataaaatatgatgtgaatgatattttataaagttattttgtatggtgtcaattttgttttgcctcatagtatgtcagcaaaaaattaaataaaagtcctcctatttacagctgcttccaaaaa

SEQ ID NO: 30196 - DNA, 5115 bp, Homo sapiens
  misc_feature (4965)..(4965): n is a, c, g, or t
  misc_feature (4975)..(4975): n is a, c, g, or t
  misc_feature (4982)..(4982): n is a, c, g, or t
  misc_feature (4989)..(4990): n is a, c, g, or t
  misc_feature (4997)..(4997): n is a, c, g, or t
  misc_feature (5000)..(5000): n is a, c, g, or t
caacaccgactgtcatgcaaataatacatttaaaatagttgcatggtttcaaagacaatgcagacgtaattggcctttgactttgggacctcgggttactctcactccctactgcaaaacaaactaagggttgaaagcaaagcattctgttcaaatccagggccctttgtttgaaaagaacacagggcccacagctggtgttttgaagtagaagttcccactagtggcgcagtggaccgtctgatgctgacttgcaggaagtcggtcctgggaggctctgaacacccctccctgtgattaaccactttgctgtcagaaatgtcattttcccatacactgtgctgtgggcccggggcctccttcgcttctttctttgggttccatatgttgcccgatcttgaggttagcgctcgccccaatttctccatgagtttactctgagttgacaggcgatgatctgacagttggaggtgtctgggtgtttggaggtggccccgttctcatgttggctgctcatcagacattgagtttggccccggcggttctactacgtcactacctggaagcaattgcctttaacactctgctgtttggggtttcgatgctttttatgctgcgttgcgtgctttcattccggaagagctaagtgtcctttgcagtctctctgagaatgttttgtaattctgccgccacgctgttctgtgcggaccgacctcaagaggcttgggcccccgtgggtgtcccactgcctgccggcccagggtacaggctgcttgggtccgctgggctggccttgggctgtcagaatctggtccagggtgtttcgaggggacactgcacagccgctcgcccctcgactcagtcatgggagctgcagcacgcagatccaccgcaagcttcctgcacgcgcatctccggaatgctgcgctgggccctcccaccatcttcgcgtttgtgagaatttactcagaagtgagagaactgaagattcctggtgcttttgttaacacgtttctatcttattggttggtgtggaaatgttagatgtgttgttaggtttttaaatgctgtgggtggtatgattaaagggttaagtcctcacctcagcccccagcccccttttggggggtaggaagaggctgagttatctcctatttaaaacctccttggatttaagtagttcagagttaaagctaaaacaccaaatattaactctttcccccaagtgtctccaggaactggacgttggggccattcttattcagttctttctgtagctccaaggtccttaaaatgagtgagttgatcccaagaacaccccacagcaccaaccagcagggcacagtgcaagcgacttcatagatcggggtgctcgtgtaggggtccggggctcctttgaactctgggagttgtgtgcgcagtcttgggtgggagacggcaggtccctctgtcccaagaagctggtggtgccaaggccttcctctgtctccatcagtgccagcctgatcgcgttctggaagacccagtctcagactctgtgcctttaaagtccggtcctcagtgtcctttcagaatcatgttggggctgcgtttctctggggaactaagcctgtgccattccacaaggcaggcgtggacctccagccttggaagctttctttccgctcctcagcccctgacttgtaaactgtgatgccatgcagtctggagccgcgggggacgcactcggtctcattgcggaaaacacttggttccagtcgtgtggtttctcccataccctgaccaagtccacctctgccaggattgcaggagattggtgcaagacccatctcttatgcattgaccatgaccatcagcaaagcctggtggtcttgttctcatagtcactcgagaagaatatttattgtaatggaagtagattttttaaaaaaggaattggaatcatgtctttgtagaatgtgtgtgtgtgaagtcctcagctgtaaggtgctattcagtcctgtgacccttattttggaatgctcttcattactgttgctctgttttgtgacttcctgggaaaccgcctactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcgtgactcaaaccctacagtatggagggtggcgttgcattgaaattccaggcctgagtttgatagtggattttaatgtagttgttaaaggtatgaattcatgttttataactgtagaggcaagcaagtttttattttttaaaaagttttgagagaataatttataagtttctgtgcagcaaagtggctaattactcattaaatacaggaaaagaatgtagtatctaaatccagctttttcttacctctggtacacttcagattacttacctaatacatattgagggcttttaacccttagttttatcaatttttctagttttattttatttttataaaataattgaaaaagaaccaaaaatgaattcagaagttccatagatggatttttgccccttcttaattttctcccacaatgaaaacattttagaagacattttgaatcaaaatgtattatgaccattgaaagttctctattttctaagaagctgagcagctccaagggcctcgtttcaggtggtactctatgtattgtctgtgggcttgtttctacctgtacagtggaaccatgtgaccatgtcttgtgcttgcaatatagaaaccatgcagtgctgttttgtgaattggcagtttctgtataaactcttatttatatacattggcctctctgtatgattttccatttgctacatgaattgtaaaattaattataaaattatagtacctgctaaatacaattctgaggcttcatgtcattgtctttagttgaataccatgctgtgtgtcttgaagatgtccacgcttgcatgatgctaggtggcaatgccactttaaattaagccttaatcagatgttaaatttgtgagtttcagagtatgcaaaaatattaggcagagtgagtgtaaactgttcagatcaagatgctgtatcataattcaagttatttttttctggagttaaagggaagcattcagtgatacacctctctctctctctctctctctctcttgtctagcttggctatggccatagcttgatgaaaatggaccattgtgcatttctgtgacagtcaaaaagacctgttctaaaagtcttgcgactttttcagggttttttttttttttcatgtttctttttttttttcccctccagtctgagatttctgtgtggctgatggagagtgtgatttgggcgtaggtcttatttgcaaacctgctcatgttctaagctttcttcaggtagtaccacctgtcatcgcttctgcatatgatttaaatggatttttgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcccccctgtgaaaagaaaaaaaaaatgtccaagagcaaatttaacattttacaaacaataaagtccaaactcctctatgcacatatttatagcttatcacttcattttctgtgccagtgaaggggtggccagaaaaaaaatcccaagtaccctcatcattgcttttctagccattcatgccccctcttcctctggcacattttctaagagtttatttcataagcagcaaacggactgttgtcgatttcatctctcctgacctacctggtggaggtgctaatggccatggacagaaaggggcgagccagagctcgtggctttgtggaggcagaggcctgcattcagcagcggccctgtgtgcctgtaagttaggaaggctttctgacaggtaagaaaatgagataggttgatgacttaccatgcttttatatttggcagtttacaattctagacttttcctactatggcgatctttttttacttaattctttggaggtaacaatattttggagtcttaagaatttgattttataccaataagaaataaaaattagggatctttcctgtagtatatagttttactattttaaagagatctctgaattttacaagagaaccaacattccttaatggcagaactttgaaagttgatttgggaggctttttgctgcaggatctcaaaaatagagagagagatgattctacttaaatgtttttaattttctaacttccatcaggttgatacttaagctctattttgtaaagagtaaatcatcctttagtatgctgcataagatgatcagcattcttgcactttctcagtaataagacgtgccgggcaattggctccccaggacgcattgtgtttttaacctaacgagagantggggcgggntaatttntggcccnnaaaaacngangcggtttctactaagagcaaggtggattggaatttgcaccaaggaaaaaacgtggtgcacaaaaaacaagtggcggtgtatacacagaaaagagcggcgaatactctatatcact

SEQ ID NO: 30197 - DNA, 3523 bp, Homo sapiens
gcggccgcccctcggccccggagcccctcggcggcgccaccatgtactcgggagccggccccgcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcactttaaaacacagatctttggggatcggaagcccgtgtttgacggcaggaagaatctatacacagccatgccccttccgattgggagggacaaggtggagctggaggtcacgctgccaggagaaggcaaggatcgcatcttcaaggtgtccatcaagtgggtgtcctgcgtgagcttgcaggcgttacacgatgcactttcagggcggctgcccagcgtcccttttgagacgatccaggccctggacgtggtcatgaggcacttgccatccatgaggtacacccccgtgggccgctccttcttcaccgcgtccgaaggctgctctaaccctcttggcgggggccgagaagtgtggtttggcttccatcagtccgtccggccttctctctggaaaatgatgctgaatattgatgtgtcagcaacagcgttttacaaaggcacagccagtaatcgagtttgtttgtgaagttttggattttaaaagtattgaagaacaacaaaaacctctgacagattcccaaagggtaaagtttaccaaagaaattaaaggtctaaaggtggagataacgcactgtgggcagatgaagaggaagtaccgcgtctgcaatgtgacccggcggcccgccagtcaccaaacattcccgctgcagcaggagagcgggcagacggtggagtgcacggtggcccagtatttcaaggacaggcacaagttggttctgcgctacccccacctcccatgtttacaagtcggacaggagcagaaacacacctaccttcccctggaggtctgtaacattgtggcaggacaaagatgtattaaaaaattaacggacaatcagacctcaaccatgatcagagcaactgctaggtcggcgcccgatcggcaagaagagattagcaaattgatgcgaagtgcaagtttcaacacagatccatacgtccgtgaatttggaatcatggtcaaagatgagatgacagacgtgactgggcgggtgctgcagccgccctccatcctctacgggggcaggaataaagctattgcgacccctgtccagggcgtctgggacatgcggaacaagcagttccacacgggcatcgagatcaaggtgtgggccattgcgtgcttcgccccccagcgccagtgcacggaagtccatctgaagtccttcacagagcagctcagaaagatctcgagagacgctggcatgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacgccgaggtcaagcgcgtgggagacacggtgctggggatggccacgcagtgcgtgcagatgaagaacgtgcagaggaccacgccacagaccctgtccaacctctgcctgaagatcaacgtcaagctgggaggcgtgaacaacatcctgctgccccagggcaggccgccggtgttccagcagcccgtcatctttctgggagcagacgtcactcacccccccgccggggatgggaagaagccctccattgccgccgtggtgggcagcatggacgcccaccccaatcgctactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaaacttggattttgaactgcagacctgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatgcagaggcgtccgcaggtgccgtgttctgccagcaccgcccttcacccggcctgaactaaggagcagtggcagaaggtgggccccgtgtgtttacagcatttccaggtccagagaggttggcagacaagtgccattttaataaaaaatgtatttaaaaaaagaaaaaagacaatatactgacagtctaatcatcagatttgtcctataggactgtgacatttattttccaaagtttttaaagaatacgggtctgtggtgataaatacagtacaatcctttttcactgttatgtctttaatgtaagagaaaaatatatatatctggtttgcagtattaatgtgatagatagatgctg

SEQ ID NO: 30198 - DNA, 2892 bp, Homo sapiens
gcggccgcccctcggccccggagcccctcggcggcgccaccatgtactcgggagccggccccgcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcactttaaaacacagatctttggggatcggaagcccgtgtttgacggcaggaagaatctatacacagccatgccccttccgattgggagggacaaggtggagctggaggtcacgctgccaggagaaggcaaggatcgcatcttcaaggtgtccatcaagtgggtgtcctgcgtgagcttgcaggcgttacacgatgcactttcagggcggctgcccagcgtcccttttgagacgatccaggccctggacgtggtcatgaggcacttgccatccatgaggtacacccccgtgggccgctccttcttcaccgcgtccgaaggctgctctaaccctcttggcgggggccgagaagtgtggtttggcttccatcagtccgtccggccttctctctggaaaatgatgctgaatattgatgtgtcagcaacagcgttttacaaaggcacagccagtaatcgagtttgtttgtgaagttttggattttaaaagtattgaagaacaacaaaaacctctgacagattcccaaagggtaaagtttaccaaagaaattaaaggtctaaaggtggagataacgcactgtgggcagatgaagaggaagtaccgcgtctgcaatgtgacccggcggcccgccagtcaccaaacattcccgctgcagcaggagagcgggcagacggtggagtgcacggtggcccagtatttcaaggacaggcacaagttggttctgcgctacccccacctcccatgtttacaagtcggacaggagcagaaacacacctaccttcccctggaggtctgtaacattgtggcaggacaaagatgtattaaaaaattaacggacaatcagacctcaaccatgatcagagcaactgctaggtcggcgcccgatcggcaagaagagattagcaaattgatgcgaagtgcaagtttcaacacagatccatacgtccgtgaatttggaatcatggtcaaagatgagatgacagacgtgactgggcgggtgctgcagccgccctccatcctctacgggggcaggaataaagctattgcgacccctgtccagggcgtctgggacatgcggaacaagcagttccacacgggcatcgagatcaaggtgtgggccattgcgtgcttcgccccccagcgccagtgcacggaagtccatctgaagtccttcacagagcagctcagaaagatctcgagagacgctggcatgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacgccgaggtcaagcgcgtgggagacacggtgctggggatggccacgcagtgcgtgcagatgaagaacgtgcagaggaccacgccacagaccctgtccaacctctgcctgaagatcaacgtcaagctgggaggcgtgaacaacatcctgctgccccagggcaggccgccggtgttccagcagcccgtcatctttctgggagcagacgtcactcacccccccgccggggatgggaagaagccctccattgccgccgtggtgggcagcatggacgcccaccccaatcgctactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaaacttggattttgaactgcagacctgtatgagaacccaatgtcataggaaatatggtttgctaaaatctataagctgcttattaaaacagagtcccgtgtgtcct

SEQ ID NO: 30199 - DNA, 2535 bp, Homo sapiens
gcggccgcccctcggccccggagcccctcggcggcgccaccatgtactcgggagccggccccgcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcactttaaaacacagatctttggggatcggaagcccgtgtttgacggcaggaagaatctatacacagccatgccccttccgattgggagggacaaggtggagctggaggtcacgctgccaggagaaggcaaggatcgcatcttcaaggtgtccatcaagtgggtgtcctgcgtgagcttgcaggcgttacacgatgcactttcagggcggctgcccagcgtcccttttgagacgatccaggccctggacgtggtcatgaggcacttgccatccatgaggtacacccccgtgggccgctccttcttcaccgcgtccgaaggctgctctaaccctcttggcgggggccgagaagtgtggtttggcttccatcagtccgtccggccttctctctggaaaatgatgctgaatattgatgtgtcagcaacagcgttttacaaaggcacagccagtaatcgagtttgtttgtgaagttttggattttaaaagtattgaagaacaacaaaaacctctgacagattcccaaagggtaaagtttaccaaagaaattaaaggtctaaaggtggagataacgcactgtgggcagatgaagaggaagtaccgcgtctgcaatgtgacccggcggcccgccagtcaccaaacattcccgctgcagcaggagagcgggcagacggtggagtgcacggtggcccagtatttcaaggacaggcacaagttggttctgcgctacccccacctcccatgtttacaagtcggacaggagcagaaacacacctaccttcccctggaggtctgtaacattgtggcaggacaaagatgtattaaaaaattaacggacaatcagacctcaaccatgatcagagcaactgctaggtcggcgcccgatcggcaagaagagattagcaaattgatgcgaagtgcaagtttcaacacagatccatacgtccgtgaatttggaatcatggtcaaagatgagatgacagacgtgactgggcgggtgctgcagccgccctccatcctctacgggggcaggaataaagctattgcgacccctgtccagggcgtctgggacatgcggaacaagcagttccacacgggcatcgagatcaaggtgtgggccattgcgtgcttcgccccccagcgccagtgcacggaagtccatctgaagtccttcacagagcagctcagaaagatctcgagagacgctggcatgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacgccgaggtcaagcgcgtgggagacacggtgctggggatggccacgcagtgcgtgcagatgaagaacgtgcagaggaccacgccacagaccctgtccaacctctgcctgaagatcaacgtcaagctgggaggcgtgaacaacatcctgctgccccagggcaggccgccggtgttccagcagcccgtcatctttctgggagcagacgtcactcacccccccgccggggatgggaagaagccctccattgccgccgtggtgggcagcatggacgcccaccccaatcgctactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacaggtgagtggcatgcctggctgga

SEQ ID NO: 30200 - DNA, 1540 bp, Homo sapiens
gggacacttctcgtccccatcttcccgagagtccaggcacatgcccaggaaaggaaagttttgggaacccctgaccacactcactgcctgttcctgcaggtggtgggcagcatggacgcccaccccaatcgctactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaaacttggattttgaactgcagacctgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatgcagaggcgtccgcaggtgccgtgttctgccagcaccgcccttcacccggcctgaactaaggagcagtggcagaaggtgggccccgtgtgtttacagcatttccaggtccagagaggttggcagacaagtgccattttaataaaaaatgtattta

SEQ ID NO: 30201 - DNA, 1526 bp, Homo sapiens
caagacagacactctgggcaagaccgacactctgggcaagacagacactctgggcaagacagacactctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccatccgtgaggcctgtatcaagctagaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaaacttggattttgaactgcagacctgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatgcagaggcgtccgcaggtgccgtgttctgccagcaccgcccttcacccggcctgaactaaggagcagtggcagaaggtgggccccgtgtgtttacagcatttccaggtccagagaggttggcagacaagtgccattttaataaaaaatgtattta

SEQ ID NO: 30202 - DNA, 2210 bp, Homo sapiens
gggacacttctcgtccccatcttcccgagagtccaggcacatgcccaggaaaggaaagttttgggaacccctgaccacactcactgcctgttcctgcaggtggtgggcagcatggacgcccaccccaatcgctactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagaataccagcccgggatcactttcattgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccatccgtgaggcctgtatcaagctagaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaaacttggattttgaactgcagacctgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatgcagaggcgtccgcaggtgccgtgttctgccagcaccgcccttcacccggcctgaactaaggagcagtggcagaaggtgggccccgtgtgtttacagcatttccaggtccagagaggttggcagacaagtgccattttaataaaaaatgtattta

SEQ ID NO: 30203 - DNA, 3445 bp, Homo sapiens
caacaccgactgtcatgcaaataatacatttaaaatagttgcatggtttcaaagacaatgcagacgtaattggcctttgactttgggacctcgggttactctcactccctactgcaaaacaaactaagggttgaaagcaaagcattctgttcaaatccagggccctttgtttgaaaagaacacagggcccacagctggtgttttgaagtagaagttcccactagtggcgcagtggaccgtctgatgctgacttgcaggaagtcggtcctgggaggctctgaacacccctccctgtgattaaccactttgctgtcagaaatgtcattttcccatacactgtgctgtgggcccggggcctccttcgcttctttctttgggttccatatgttgcccgatcttgaggttagcgctcgccccaatttctccatgagtttactctgagttgacaggcgatgatctgacagttggaggtgtctgggtgtttggaggtggccccgttctcatgttggctgctcatcagacattgagtttggccccggcggttctactacgtcactacctggaagcaattgcctttaacactctgctgtttggggtttcgatgctttttatgctgcgttgcgtgctttcattccggaagagctaagtgtcctttgcagtctctctgagaatgttttgtaattctgccgccacgctgttctgtgcggaccgacctcaagaggcttgggcccccgtgggtgtcccactgcctgccggcccagggtacaggctgcttgggtccgctgggctggccttgggctgtcagaatctggtccagggtgtttcgaggggacactgcacagccgctcgcccctcgactcagtcatgggagctgcagcacgcagatccaccgcaagcttcctgcacgcgcatctccggaatgctgcgctgggccctcccaccatcttcgcgtttgtgagaatttactcagaagtgagagaactgaagattcctggtgcttttgttaacacgtttctatcttattggttggtgtggaaatgttagatgtgttgttaggtttttaaatgctgtgggtggtatgattaaagggttaagtcctcacctcagcccccagcccccttttggggggtaggaagaggctgagttatctcctatttaaaacctccttggatttaagtagttcagagttaaagctaaaacaccaaatattaactctttcccccaagtgtctccaggaactggacgttggggccattcttattcagttctttctgtagctccaaggtccttaaaatgagtgagttgatcccaagaacaccccacagcaccaaccagcagggcacagtgcaagcgacttcatagatcggggtgctcgtgtaggggtccggggctcctttgaactctgggagttgtgtgcgcagtcttgggtgggagacggcaggtccctctgtcccaagaagctggtggtgccaaggccttcctctgtctccatcagtgccagcctgatcgcgttctggaagacccagtctcagactctgtgcctttaaagtccggtcctcagtgtcctttcagaatcatgttggggctgcgtttctctggggaactaagcctgtgccattccacaaggcaggcgtggacctccagccttggaagctttctttccgctcctcagcccctgacttgtaaactgtgatgccatgcagtctggagccgcgggggacgcactcggtctcattgcggaaaacacttggttccagtcgtgtggtttctcccataccctgaccaagtccacctctgccaggattgcaggagattggtgcaagacccatctcttatgcattgaccatgaccatcagcaaagcctggtggtcttgttctcatagtcactcgagaagaatatttattgtaatggaagtagattttttaaaaaaggaattggaatcatgtctttgtagaatgtgtgtgtgtgaagtcctcagctgtaaggtgctattcagtcctgtgacccttattttggaatgctcttcattactgttgctctgttttgtgacttcctgggaaaccgcctactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcgtgactcaaaccctacagtatggagggtggcgttgcattgaaattccaggcctgagtttgatagtggattttaatgtagttgttaaaggtatgaattcatgttttataactgtagaggcaagcaagtttttattttttaaaaagttttgagagaataatttataagtttctgtgcagcaaagtggctaattactcattaaatacaggaaaagaatgtagtatctaaatccagctttttcttacctctggtacacttcagattacttacctaatacatattgagggcttttaacccttagttttatcaatttttctagttttattttatttttataaaataattgaaaaagaaccaaaaatgaattcagaagttccatagatggatttttgccccttcttaattttctcccacaatgaaaacattttagaagacattttgaatcaaaatgtattatgaccattgaaagttctctattttctaagaagctgagcagctccaagggcctcgtttcaggtggtactctatgtattgtctgtgggcttgtttctacctgtacagtggaaccatgtgaccatgtcttgtgcttgcaatatagaaaccatgcagtgctgttttgtgaattggcagtttctgtataaactcttatttatatacattggcctctctgtatgattttccatttgctacatgaattgtaaaattaattataaaattatagtacctgctaaatacaattctgaggcttcatgtcattgtctttagttgaataccatgctgtgtgtcttgaagatgtccacgcttgcatgatgctaggtggcaatgccactttaaattaagccttaatcagatgttaaatttgtgagtttcagagtatgcaaaaatattaggcagagtgagtgtaaactgttcagatcaagatgctgtatcataattcaagttatttttttctggagttaaagtggatcaaaagtggatcatccagccagacaagcagtattaagtgaacat

SEQ ID NO: 30204 - DNA, 1819 bp, Homo sapiens
gggacacttctcgtccccatcttcccgagagtccaggcacatgcccaggaaaggaaagttttgggaacccctgaccacactcactgcctgttcctgcaggtggtgggcagcatggacgcccaccccaatcgctactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagaataccagcccgggatcactttcattgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgagtgcgtgcagatgaagaacgtgcagaggaccacgccacagaccctgtccaacctctgcctgaagatcaacgtcaagctgggaggcgtgaacaacatcctgctgccccagggcaggccgccggtgttccagcagcccgtcatctttctgggagcagacgtcactcacccccccgccggggatgggaagaagccctccattgccgccgtggtgggcagcatggacgcccaccccaatcgctactgcgccaccgtgcgcgtgcagcagcaccggcaggagatcatacaagacctggccgccatgcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaaacttggattttgaactgcagacctgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatgcagaggcgtccgcaggtgccgtgttctgccagcaccgcccttcacccggcctgaactaaggagcagtggcagaaggtgggccccgtgtgtttacagcatttccaggtccagagaggttggcagacaagtgccattttaataaaaaatgtattta

SEQ ID NO: 30205 - DNA, 2441 bp, Homo sapiens
gcggccgcccctcggccccggagcccctcggcggcgccaccatgtactcgggagccggccccgcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcactttaaaacacagatctttggggatcggaagcccgtgtttgacggcaggaagaatctatacacagccatgccccttccgattgggagggacaaggtggagctggaggtcacgctgccaggagaaggcaaggatcgcatcttcaaggtgtccatcaagtgggtgtcctgcgtgagcttgcaggcgttacacgatgcactttcagggcggctgcccagcgtcccttttgagacgatccaggccctggacgtggtcatgaggcacttgccatccatgaggtacacccccgtgggccgctccttcttcaccgcgtccgaaggctgctctaaccctcttggcgggggccgagaagtgtggtttggcttccatcagtccgtccggccttctctctggaaaatgatgctgaatattgatgtgtcagcaacagcgttttacaaaggcacagccagtaatcgagtttgtttgtgaagttttggattttaaaagtattgaagaacaacaaaaacctctgacagattcccaaagggtaaagtttaccaaagaaattaaaggtctaaaggtggagataacgcactgtgggcagatgaagaggaagtaccgcgtctgcaatgtgacccggcggcccgccagtcaccaaacattcccgctgcagcaggagagcgggcagacggtggagtgcacggtggcccagtatttcaaggacaggcacaagttggttctgcgctacccccacctcccatgtttacaagtcggacaggagcagaaacacacctaccttcccctggaggtctgtaacattgtggcaggacaaagatgtattaaaaaattaacggacaatcagacctcaaccatgatcagagcaactgctaggtcggcgcccgatcggcaagaagagattagcaaattgatgcgaagtgcaagtttcaacacagatccatacgtccgtgaatttggaatcatggtcaaagatgagatgacagacgtgactgggcgggtgctgcagccgccctccatcctctacgggggcaggaataaagctattgcgacccctgtccagggcgtctgggacatgcggaacaagcagttccacacgggcatcgagatcaaggtgtgggccattgcgtgcttcgccccccagcgccagtgcacggaagtccatctgaagtccttcacagagcagctcagaaagatctcgagagacgctggcatgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacggtaggtgtgggcgctcccgctggctgtggggagccgtcgtggtctccgtgggtgtttgttcctgcctaagcccctctgtgtttctgctgcactgagaaaggtgctccttttgggcctttcaggaggctgaggaagaagaggtggcttgtcatcactgccacttctgatcactgtgttcagggcctccccgtcgtcctgtatgatgccatggtcctgggcagtcagcaccctcaggtggcacaggccttggcacatgggtgggcaccccgcccatcatacagcatgcgtgttggctggatgggggaacgtttgtttaacgcacagagcgttgcaccagggtcacctcctgcccgggactcagcctatgtgtaaccactctgtgcccacctcagaattttgtggagtttcgccaaagtccatgccagggggtcacccacagggccccacgctgagccacagacagattattgacatgtaaaaaccacacttctctcagttcaacatcccaaaaaaaaaaaaaacaaccaacacaaaaaaacactttttggggcgcgtttgggcccttcaaaaacgtttctctaaacaacccaccttttttgtgcccacgggcccccaaatatgatgacggtagaaccctgcggcacaagcgggttccaaagggaaaaactccggggcctagacacaggcgctcgggtttcctcgcccaatttaaaaacgcgccggcgggacaccagcggtttgtgaacaaactccaagggattctaaggcccatacgggatctatcaaggggattcagggagccgattaagtc

SEQ ID NO: 30206 - DNA, 1026 bp, Homo sapiens
  misc_feature (951)..(952): n is a, c, g, or t
  misc_feature (955)..(955): n is a, c, g, or t
  misc_feature (960)..(960): n is a, c, g, or t
  misc_feature (963)..(963): n is a, c, g, or t
  misc_feature (967)..(967): n is a, c, g, or t
  misc_feature (969)..(969): n is a, c, g, or t
  misc_feature (972)..(972): n is a, c, g, or t
gcggccgcccctcggccccggagcccctcggcggcgccaccatgtactcgggagccggccccgcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcactttaaaacacagatctttggggatcggaagcccgtgtttgacggcaggaagaatctatacacagccatgccccttccgattgggagggacaaggtggagctggaggtcacgctgccaggagaaggcaaggatcgcatcttcaaggtgtccatcaagtgggtgtcctgcgtgagcttgcaggcgttacacgatgcactttcagggcggctgcccagcgtcccttttgagacgatccaggccctggacgtggtcatgaggcacttgccatccatgaggtacacccccgtgggccgctccttcttcaccgcgtccgaaggctgctctaaccctcttggcgggggccgagaagtgtggtttggcttccatcagtccgtccggccttctctctggaaaatgatgctgaatattgatgtgtcagcaacagcgttttacaaaggcacagccagtaatcgagtttgtttgtgaagttttggattttaaaagtattgaagaacaacaaaaacctctgacagattcccaaagggtaaagtttaccaaagaaattaaaggtctaaaggtggagataacgcactgtgggcagatgaagaggaagtaccgcgtctgcaatgtgacccggcggcccgccagtcaccaaacattccggtgcagcaggaaacggcaaacgggnntgncgtgnccntttnangcnggccaagttggttggacccactcgcatttacgtggcaggcggaaactacttccg

SEQ ID NO: 30207 - DNA, 1161 bp, Homo sapiens
gggacacttctcgtccccatcttcccgagagtccaggcacatgcccaggaaaggaaagttttgggaacccctgaccacactcactgcctgttcctgcaggtggtgggcagcatggacgcccaccccaatcgctactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagaataccagcccgggatcactttcattgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgataaactaatactaaaagtttggcatagtgttttttcacctccttacataacccctaacatgcacagaatgctgtaaatctgataaaatatgatgtgaatgatattttataaagttattttgtatggtgtcaattttgttttgcctcatagtatgtcagcaaaaaattaaataaaagtcctcctatttacagctgcttccaaaaa

SEQ ID NO: 30208 - DNA, 491 bp, Homo sapiens
ccctccctctttttgtgtttgtttggctctctctctctctctcttgtctagcttggctatggccatagcttgatgaaaatggaccattgtgcatttctgtgacagtcaaaaagacctgttctaaaagtcttgcgactttttcagggttttttttttttttcatgtttctttttttttttcccctccagtctgagatttctgtgtggctgatggagagtgtgatttgggcgtaggtcttatttgcaaacctgctcatgttctaagctttcttcaggtagtaccacctgtcatcgcttctgcatatgatttaaatggatttttgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattg

SEQ ID NO: 30209 - DNA, 217 bp, Homo sapiens
aagctcacacatgttgtaaagtctgtcatgcctgttctcatacacgaaactatttcactgaggaggagagagcagttcactgccacatgcttcgtcctgagatccataaaaactaccttctctgtgttgtggctttcagtgatgggggtttaacttgtctaggtccagacacggatatcgagaacttgctgaaaccaccaaactttaagtacaaagt

SEQ ID NO: 30210 - DNA, 728 bp, Homo sapiens
attattatttgtagagatgagatctctccatgttgcccaggctgatctcgaactcctgggctcaagcgatcctcccacatcagcatcctaaagtactgggattacaggcttgagccaccattctgggcactaaatataatttttaatgataaatgatttttccacctcccaggttcaagtgattctcctgcttcagcctcccgagtagctgagattacaggggtgcaccaccacagccagctaatttttgtatttttagtagagatggggtttcaccatgttggccattctggtgtcgaactcctgacctcaaatgatcttccagcctcggcctcccaaagtgttgggattacaggcgtgagccaccgcatctggccaagaaatcctcttttttttttaattttattttatttttgagatggagtctcactctgtcgcccgggctgtagtgcagtggcactatctcggctcactgcaacctctgcctttagggttcaagtgattctcttgcttcagcctcctgagtagctgggattacaggcgcccgccaccatgcccagctaaaggaaatcccctgtaaggaggaaagtttaaaaacaaatttaaaaaggaaagaaaaagacgtacaaaattcgcggtacctgtcttattctaataaaaaatatgatatttatccacagatataggaactaacggggggagaaaattttctcttttatgacgtatat

SEQ ID NO: 30211 - DNA, 397 bp, Homo sapiens
ttttttaaggcagggtcccactccgtcgcccaggctggagtgcagtggcacaatctcggctcactgcagccttgacctcctggggctcaagcaatcctttcacatcagcctcccaagtagctgggaccacaggcgtgcaccaccatacctggccaatttttgtattctttgtagagatagggttctgccacattacccaggctgatctcgaactcctgagctcagacaatccaaccaatgtggcctcccaaagtgctgggactataggcatgagcaccgtacccagccgggtaaggtcttaacaacagtatgatatgaccattctgaccagactccactctaacagatgttggttccccctatcaatttcctgtgacaactcagagcctccctctat

SEQ ID NO: 30212 - DNA, 359 bp, Homo sapiens
taaagaattcatcagctctttgattgaaggttagatcttgttaatcttagccatataaagaagtctagaccaggcatgacggctcacacctataatcccagcacttggggaagtcaaggcaggaagatcacttgaacccaggagttgggaccagcctaggcaacatactgagaccctcgtctctacaaaaaaatagaaaaaattagccaggcgttgtggtacatgcccatagtcccagctactcagaaagcttagatgggaggatcacttgagcccagaaggcagaggttgcagtgaaccgagactgcaccactgcactcttggggcagcctaggtaaagagtgagaccttgtctcttt

SEQ ID NO: 30213 - DNA, 252 bp, Homo sapiens
agagacacagtcttgctctgtcacccagcctggagtgcagtggcacaatcatggctcactgcagtcttgacatcctgggctcaagtcatccccctatctcagcctcctgagtagctgggattacaggcatgtgccatcatgcttggtggctgtctgccgagctgggattaactgcacacttcatgtgccagcaccccgggcccccaccacaccatagagggaatggccaattgagctgccccaatattaact

SEQ ID NO: 30214 - DNA, 403 bp, Homo sapiens
catcattattattatttttgaaacaggatctcactatgttacccaacgctggactcaaatcctgggcccaagccatcctcctgtctcagccttgggagtagctgggactacagacccatgcaccatgcccagcttattagaaaatcattactttgcatggggaaaatatggatatttccctgccaaatcattaccctttgaataacaacttcaaaaatataaattcaacaaagcagttgctttgatgatatattagagctaatataatatataacgaaatgagccatatataataaactttttagggtgcttgtgttttattatttcttccaagaaaatattaaagaaggtgaagaaaactaatggaccattacaacattaactttagtctgggaaatatgta

SEQ ID NO: 30215 - DNA, 377 bp, Homo sapiens
cccagcagctcaggaggctgaaacaggaagatcacttgagcccaggaggttgaggcggtggtgagctgtgatcgagccactccactccagcctgagcgacagactgagatcctgtctcaaaaaaaaaaaaaaattttttttttaatgtacatatatctcgacccagcaattccacttacaggtaattattctagagagagatggatgcacgttcaaggctgtgttcatagtaaatgcaaggtagaaataataatgctttaaaagtacatcaaatggaggcccggtgcagtggcacatgcctgtaatcccaggtactcgggaggctgaggcaggagaatcacttgagcccaggaggtggaggttgtggtgagctgaga

SEQ ID NO: 30216 - DNA, 870 bp, Homo sapiens
agccagttcctgctatatgatctgttttctagcctcgctaatgtgagactgaagcattcttaccaaagaaatcatttcctagtaaagaagcccattgaactcactttatttgtttatttccttcgaaagccaccgaagagagaaaaacagagaaggtgtgtagtgtggcggaaaaagcacagcatatagttttacagacttgggtctgcagctgactagctgggtggcctggggatagtggcttcatcttttggggcttcaagattctttgtctttaaaatcaggggttatatcagatcatcaaagttcccattccattaaagaaaaccctgcatgtatccataatgatgctctcctgttaaatttacaatgaaggaaacacatcacttaactgtaagaatttcccaaaatgaactgatgaccagtgatctctctatcagagaaatgtcagatttctagcctccagaactttgatttttctggacattcaatagttcctctttctcagatatttttcaactgatgccagaaacacttggtatttgtttttaatccaacccttttgttttgaggctttggagggtaacacattttcataccctgtgagtcccaggatccacagctctgctgtggtcttagaagccactgaaacattggtgaatgtgaagtcacttttggggtgcctgccctcatccctctgtctctctgcttccgtgtaaataaagactgtttcaattgtgtcctctctgtgtcatggactgttccaatgtcatgcagatttctgtgtctgatatggattttaaaagttgttctctttgtggaatataagtgtacagaataataaataatgtttcctgggctgtgtatctg

SEQ ID NO: 30217 - DNA, 447 bp, Homo sapiens
agtgcccctgctcattagctgtttctgtacccaagtgcataggctacgcactgtgactgatgtggatctatttgcccctcgctacaaaagggtctcaagtccttgtcccttcagtgtgtgggaccccatcgtgttaccaatggggcttggggactgaggctcaagactgcttgctgggaaatgtaacccctttgttctggacaggtagaaggagaggagaatggtcatcccaggcctaatgtaaagtttctgcaacccaacccaattcccagactcattttggtcatgatcaatacaggggtcaacaaaattttctgtaaagggcgagctagtaaatagatttgctgtgtgtactatgctgtctctgttgcaaccaactcggccattgtaaccttgacaacatgcaaatgatgggcgtgactgcatgccaataaaactttatttaga

SEQ ID NO: 30218 - DNA, 832 bp, Homo sapiens
cgccgtaggagattaacaaaaggatttgtggaaactattaatggctcttaataagatcaaaatttgggaacgaataaaaaaccatctagaaggacactatacaaactggtttttggatattgcaaagttaaaagaacaaatatttaaagcatcccaggcacatctgaccttaataccaggaactggagtgcttgaaggagctgcagacggattagcagccagtaacccattaaaatggatgaaaacacttggaagctctgtgatttcaatgatgattgtgttattaatctgtgttgtttgtctttgtgtagtctgcagatgcagatcctgactcctgcgagaagtagctcaccgtgataaagctgcctttgcttttattgccctgcaaaaacaagaagggggatatgctggggaataggcccccaaatctggacataaactggccccaaaactggccataaacaaaatctctgcagcgctgtgacatgttcatggtggccataacgcccatgctggaaggctgtggtttaccggaatgagagcgaggaacacctggcctatccagggcggaaaaccacttataggtattcctaaaccacaaacaacctatgccttaaggacatgttcctgctgcagataactagccagagcccatccctttgtttcggcccatccttttgtttcctgtaaggagtgcttttagttaatctataatctatagaaacaatacttatcactggcttgctgtcaataaatatgtgggtaaatctctgctcatggctctcagctctgaaggctgtgagtcccctgatttcccactccacatgctata

SEQ ID NO: 30219 - DNA, 527 bp, Homo sapiens
ttcttgtaattaccatctacaccagcatttcaggtatagctctttataactctggagacatgtaaaacatgtttaacacccacgagttttgaaagttgcattccttattagagtaggaactctctagcccaactccattctatgttctcagctccctccaccccccaaaatacatcagactagcaaggcagtcctatgtttacaaaacgagtttagattgtcatttcattccataactcttaataatactcaagttttatacattcacgtattttaaatgctcggtctgtagaagacactaggagaattgcattccaattactggatggttgctgctctggctttttagaacttgaaattaatttttatttagagcaaaggaggaaatcttttaagaggctaaaatcatgctgctattattgctgtgaaattgtataaagattaggattcatgccagtttttattttaaaaaataatgtgcattttaagggtttatatttagaaaaaaataaaatgtttcaagaaca

SEQ ID NO: 30220 - DNA, 443 bp, Homo sapiens
cccaacagttgactgtcactgacaatgttggaagtcatctggaaaagagaacctctgtggtaatgtggtctcattaaagtcaagccttgttgtgattcctgtctacctccctgaagcaaagcccttctgtttattcacactaatgagccagagctgagctaaattgaatccctgtccttggaggaaaaccacatttccagaagcatgttagtttaaaggtagtaggtgagaaatgtgttctcttgaaacaagcactttgaaatttgaataggaagttgtagtgtatataggaagtctctgcctctttcgcctagtatctctgcctttgtttcaatttgttttgatttttacagactgttttgacaatgtataaaccaaggtattttgttttttggaagtatgtaaattgtgaccttcccacaaatatataaactttaaagaaa

SEQ ID NO: 30221 - DNA, 383 bp, Homo sapiens
atctataaaggagagaaaattggacccagcatttcagccaggtcataacacttcttgaaaaaattacgctgagcagatctgtggagaattagactttggtattgtattaagactctaataatggctgggcgtggtggcccgtaatcccaacactttggaaggcccaggcaggaggattgcttgagcccaggagttgaaggccagcctgggcaatatagcgagaccccatctctaccaaaaataaaaaattagtggcatgtgcctgtggccccaactactcgggaggctgagatagaaggatcgcttaagcctgggagtttgaggctgcagtgagccgtgattgttcaactgcactctagtctgggtgacagtgagaccctagc

SEQ ID NO: 30222 - DNA, 331 bp, Homo sapiens
tgttcttctaattttctccactttttaaagtcaaaaacttttttttaatattttccttaaaatgcaagtatcagccgggtgcggtggcactcccagcactttgggaggccgaggtgggcagatcactagaggtcaggagtctgagaacagcctggccaacatgatgaaatcccatctctattaaaaatacaaaaaccagcagggcgaggtggcgggcacctgtaatcccagctacttggaaggctgaggcagaataatcatttgaacctaggaggaggaagtttcagtgagccaagattgtgccactgcactccactgtctcaaaaaaata

SEQ ID NO: 30223 - DNA, 328 bp, Homo sapiens
taaaggttctctgtggtaccaggtaactgcataaatcttagttttgaaaggattcctcttagactttagtgagggaaggacagtaacagagagactagaaagagactgttgcaactctagttataatccaggtaagaaatgacagtggcctggcccaaggtggtattcaaggagatgtcgagagaaggtcagatatacatctggcagacagagccaacagaatttgttgtcagattggatgtggactatgagagagagaacattctaagctttctggcttgagcagctagaggattgagttgtcgttactgagatggggaagacggat

SEQ ID NO: 30224 - DNA, 1345 bp, Homo sapiens
gtcataagcctccctgtttgcatcccaacatacactggtgtcctggctgatgggatgtgcactgggtctggaaagacttggtgttatctagggcttttgaagtggatcttgtgggctagcctctcaggggatcccacaggcctgaacacaagaggattttttgtttgtttgtttatttagagacaaggtcttgctctgtcacccaggctgaagggcagtggtgtgatcatagctctacagcctcaaactcctgggcttaagccaccttcccacctcagcctcctaaaatgctgggattacaggtgtgagccactgtgtccagccaacatgaggttttaaagggaggaaaagaagccactgctctgtgggactgtctcctgtggaacctttgttttcattcagggagaaaatggttttattgtagcaggagctaacatcatgtctgatcctgactgatatttggatggcaactgtaggaagtacctaacttaccattaaaatcgggtctgaaagtagttctaatccccaggggaggaatgaaaatattaatgaggattattttgcctcattattcctctccttcttgtaagccttagctgtctcatgtgtaagaaaatgttctttctcaactgtccttcctcttcttgaggtaaaatttctaatcaaatgagatagtttccacacagtttggtaagtgtgttgccttctccactggagtgagaaattccctagaggctttggccaacaggactaaatctctgccctcccacctacagacttggaatcctcgagcatgcctgactggccttcagcctcctcatctgaaactcgctcacactgctcaggagatgactgtgagcaatcaggggtcatactctgattaaagtgggctactctttgattcttagaatatttcaactctcccttccaacctcccccaaaatatatgttgatttgaaaagcattatcatctgactgggaaaagtgacaatgaaacattaggaatccaggcaccctttttgtgtcaagctgacctgtaagaggagttatagagccttgttttcctggcagggcagtggtcggataaagagtaaggcaaaagctaagagagactgaggcaactgacccagaatctgaagactggctacacacttcagagctaacagtgggagtatatggactctccagccttagacaatctaactcaacctcccatttctcactgtgatggcttgtgttttcacatttgacaatttctgaggtcactctggaggtatgttctacatcagcagatggaagtaaaaatcatgaataaaagctgactgttgtgtttgaaccttgttgg

SEQ ID NO: 30225 - DNA, 329 bp, Homo sapiens
gtccatgctgacactctaaggtccatatcaacaagtgaaaaagaaaaacaattaaacaattcagaatagtagaaaaagtctgctttgtaccataggtaaacttgtttaggtaatgtagaagaacatgttgtctaaaatatgcagaatgatatttcattaccacatgctcttgtggtatctggccagaatggagatttatttctcctctcttctgttactgccttaatcaatatattgtaacagaaacgactttgtataggattcatagctatgttattaaaacagcatacctttgggaggccgaggcgggcggatcatgaggtcaggag

SEQ ID NO: 30226 - DNA, 296 bp, Homo sapiens
tggggatggtttctgagttgtgaggaatatcagtttcatcatagataaggtaggggttttccctttcaatgatatctggttttgggttcccttcaggctgcttcctcacagtcatgtcatccccatagggagggatattgtcagggtcatcaaaagcaacgttctcacttccctttttcttcttctccttcggtttcttctcctctttgggatttttggccttcttccccctgcactggttacacaggatcaggctaaggaccaggagggccaagacggttgcgcagctgcccacg

SEQ ID NO: 30227 - DNA, 461 bp, Homo sapiens
ggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctaggctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtct

SEQ ID NO: 30228 - DNA, 2808 bp, Homo sapiens
  misc_feature (1)..(2): n is a, c, g, or t
  misc_feature (5)..(5): n is a, c, g, or t
  misc_feature (18)..(18): n is a, c, g, or t
  misc_feature (51)..(52): n is a, c, g, or t
  misc_feature (59)..(59): n is a, c, g, or t
  misc_feature (61)..(61): n is a, c, g, or t
nnggngggggggcagccnctcgggaagagccaatcaggggcgagcgtcttnncgtcgcncnaggcccggcgcggattggcggcgcgcgtctcccacttcccctcggaggaaaggctcagctcccagcgcgcccctcccgtctccgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggctggggggcgccgcgggggccgcggaggagcgccgcgtcaaggtctccagcctgcccttcagcgtggaggcgctcatgtccgacaagaagccgcccaaggagtcgcccgctgtgcctcccgaaggcgcctcggccggggcccacctgcggccactgctgctgtcggggcaccgcgctcgggaagcgcacagccccgggccgctggtgaagcccttcgagaccgcctcggtcaagtcgggaaattcagaagatggagcggcgtggatgcaggaacccggccgatattcgccgccgccaagacatatgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagcgccaaggcgaaaagactgcaggaggcggaactggaaaagctgaaaatggctgcaaaacctatgctaccctccagcttcagtctccccttccccatcagctcgcccctgcaggcagcgtccatatacgcagcatcctacccgttccatagacctgtgcttcccatcccgcccgtgggactctatgccacgccagtgggatatggcatgtaccacctgtcctaaggaagaccagatcaatagactccatgatggatgcttgtttcaaagggtttcctctccctctccacaaaggcatagccagccagtactcctgcgctgctaagccctcgacgttgcaccccaccccctctaacggctagctgacagggccacaccacatagctgaaatttcgttctgtaggcggaggcaccaagccctgcttttcttggtgtaacttccagagtccccccttttttcccttgcacaaaagcttggctctgatggtttttttggcatgatgtatatatatatatacgaaaaatactacagaccctttttatcagcagacgtaaaaattcaaattattttaaaaggcaaaatttatatacatatgtgctttttttctatatctcaccttcccaaaaagacacatgtgtaagtccatttgttgtattttcttaaagagggagacaaattcggaggagcgccgcgtcaaggtctccagcctgcccttcagcgtggaggcgctcatgtccgatttgcaaaaatgtgctaaagtcaatgatttttaccgggattattgacttctgcttatacaagaagccgcccaaggagtcgcccgctgtgcctcccgaaggcgcctcggccggcctgcggaaaaacaaaagaaaacagacacaatgcagcagccagaaaatattagatatggagagattatggccactgctgctgaccggccacggcgtccgggaagcgcacagccccgggccgctggtgatcaaagtgaacccacatcatatttctgcattttacttgcattaaaagaaacctctttataagcccttcgagaccgcctcggtcaagtcgggaaattcagaagatggagcggcgtggatgctacatacgttgttcctatctcccgcccacgcccacacatatttttaaagtttttaggaacccggccgatattcgccgccgccaagacatatgagccctaccacctgcaccctgacctttttaagaatatttttgtaagaccaatacctgggatgagaagaatccgtagactgccggaaacacaagaccaatcggaagccgcgcacgccctttaccacatcccagctcctcgccctggaggtgaggtagaaaaattagaaatacttcctaattcttctcaaggctgttggtaactttggagcgcaagttccgtcagaaacagtacctctccattgcagagcgtgcagagttctctatttcagataattggagagtaaaatgttaaaacctgtgagaggattgtacagctctctgaacctcacagacccaggtcaaaaggttctgagaaatactaggtacattcatcctcacagattgcaaaggtgctttgggtgggggtttagtaattttctgcttaaaaaatgagtatcttgtaaccattacctatatctaaatattcttgaacaattagtagatccagaaagaaaaaaaaaatatgcttctctgtgtgtgtacctgttgtatgtcctaacttattagaaaaattttatatctttttacatgtggggggcagaaggtaaagcatgtttgacttgtgaaaatgggatgtcaaacagccataagttccctggtattcaccttcctgtccatctgtcccctccatcggtatacctttatccctttgaaagggtgcttgtacaatttgatatattttattgaagagttatctcttattctgaattaaattaagcatttgttttattctgaattaaattaagcatttgttttattgcagtaaagtttgtcca

SEQ ID NO: 30229 - DNA, 454 bp, Homo sapiens
tttttttttgtttgagatggagtctggctctgtcgcccaggctggaatgcagtgatgcaatcttggctcactgcaaccttcgccttcccggttcaagccattcttctgcctcagcctctgtagtagctgagattgcaggcgcctgccacacatacccagctaagttttgtatttttagtagagacggggtttcaccatgttgaccaggttggttttgaactcctgacctcaagtgatacacccatctcagcttccaaagggctgagactacaggcatgagctattgtgcccagtcgctattacaacctatttctaagttttccctaagtatcattttttttgtggcttattcattcatttagttagcaaatatttactgagtgccaattctgtgccaggcactgttctagtaacttgggatacaataacgaacaaaggactaagatgaggacaa

SEQ ID NO: 30230 - DNA, 474 bp, Homo sapiens
acctaattggaatgaagactataattgctacataaagtggttattcatcacgttagaaaatatgcagttgaggcaggtgcaatagcctttctttaaatactactagtcctcagcttccaaaccagaagctctgtgccttattgccttactccttggctggtgagttcagagaacccaaagtgggacagatgggccatgctggggttcttggacttaccaccacttccttgtactaaaaaactaagtaccctctaaggggcaaatttatgtggtttgggcaggtcacagtcaagggtccaagcagctatgtagaaatgaagtcacctgtgcacatggggtctccatacacagatgtgccatccttgtcgacatctaataaaaatatatatgaagttggtaggtgtctcaaataagtaacttagtgaaatcagggcactagtgcagcatttgaaataaaagtcaaccagcatctgg

SEQ ID NO: 30231 - DNA, 279 bp, Homo sapiens
ggcttggtggcacatgcctgtaatcccagttactcaggaggctgaggcaggagaatcacttgaacctgggaggcagaggttatagtgagccaagatggcgccactgcactccagcctggacaagagtgagactccctctaaaaaaaaaaaaaaacctttgcatatgagctgcagcaataaaagtgctatgagacccaacctctctgtaaccgtattctttgaaagctgtggaataaggccaagtgcagtggctcacatctaatcccagcactttggaag

SEQ ID NO: 30232 - DNA, 480 bp, Homo sapiens
cgtgccctggcctcttcatcaacgatgctgccctccaaccaccttctggcccaacaggtctgttaacttacctgctggaaggtgagtggctggaccagcgattcttgaggaccactgccttggttgctgcatccagccttcacacactggtgggcagttttgttttacctagtgtggtggccaacaccttatggtcaagagagactcaagggaaggaggaaggggggataagcatcccagctgaggaccaaggtcgtgcttgacttctgcttgtcatcagtagatggagatagcccacctcaattagtcaaaatccctaactcatatgggtctttctggaggagccagttcttatgtagttcgtaatttgtttcttgaatcatctttgcttttaaagcattacgaaataacttagtgcttttttttcctaatttttagaagatactatttattgtagaaaactgagaaaatcttgaccat

SEQ ID NO: 30233 - DNA, 452 bp, Homo sapiens
gcaaatcatgggccccggggccagattcctgcaaaccagtgttcctgcagggaccttgggctgtctcatcaatccaattgtggcaaatctcaaagaccgtctaacaaaaccagctcctgcccactcccttcctttatgtcctggaaagggtgggaaacccagccctgccatgtggcatcgagagaaagacatgagcttgggtcagacacaggctacacctccagccatgtgtgatgtctttggaaagtcaccagcctccctaagcctccaccttgagagctattatgcaagaagaactatataaagactgctaagcgatatgtatggtgcctggtacacagaaggtgcttagtgagtttgaatttccttctttgcctccttgcctttattaaggcagatttaaatgtactctgtaacaatataaattataaattcagagttctagaaagaaa

SEQ ID NO: 30234 - DNA, 447 bp, Homo sapiens
tccacattctacaactgtaaactgctaattttttgtggcttcttgctctatacaccatgcaatgcataatttatcagtttgtttaaaacattagaaagggagaaatactcagccttgtccttgaacctgagttgatactcgatctatctccatctgcattgccccctttttctctactttgtctcttattttgctgtattttttcttcctcagaactctcctgaaaagcctttgatttggtaaatatattttgggattttcagatgttgaggtttattataaatgctttaaattttctggttttattttttttaattaggttttgttgaggaacagagtgtaaaagaaaggatatggttaaaatatgaaaataagtaaaaatggtgcatgtacatcgttagtatacaaatgatatcaaatagtttagaaagagatgtcaaaggctcc

SEQ ID NO: 30235 - DNA, 408 bp, Homo sapiens
  misc_feature (13)..(13): n is a, c, g, or t
  misc_feature (16)..(16): n is a, c, g, or t
  misc_feature (35)..(35): n is a, c, g, or t
  misc_feature (38)..(38): n is a, c, g, or t
gcggccgctactnctnctactactactaaattcgnggncgtcgacaaaaaatattactacctacttatgaaaagtgaaacagaatttttacatttcttattcacattttctttttacttatgttttcactcaaaaaataataatatggtttctttttccatataaaaagaaagttgtaccctagaacaattttgcaaaatatctgctctaggggtcaaaacaggtgaagctttgtgaatgattttacactctcctgaatgtcattttatataatttcttttcaaaatcaaaagtcaaacaggaaaattactcctatccactggcctatgcactccaccagcattgatttctttttgcaaaggaaagcaagtgtgccttataacttgcatgctctgaaaatcatttata

SEQ ID NO: 30236 - DNA, 2052 bp, Homo sapiens
atttagtatacagaggaggacacaaacatgagaagattaaggtagagagtgaaatatggtcaggacaaatgtgaatttagagcctgagtgatggtttagtggatttatgtcctcacttgtcactaatgaaaaggaccttacaggttatataattaaagctctgttgacattggctcttgaaggcaaacttcataatgaggggaagagtcaagttttgtgtaacctgaagcatatacagtgtccattgccagcacttgagtaaagataaagagtaggagaatcaaagctgttgtataattagttctcttctcatccacacccataaaccagttcaagaaagggatgaaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaacaaaatggcaggatgaagtggtttcaaaggctgtttggagtcatctccatttaaggtaaggagagcactgacatggataccccagccaaccaatcgtgagattcatggccacagtatggcaccctgtactgagactaagatctttgttctttgtgatgaacagatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgaggaagaatattaagttactgaagtgtatatgcgtagggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggccatttcg

SEQ ID NO: 30237 - DNA, 1889 bp, Homo sapiens
atttagtatacagaggaggacacaaacatgagaagattaaggtagagagtgaaatatggtcaggacaaatgtgaatttagagcctgagtgatggtttagtggatttatgtcctcacttgtcactaatgaaaaggaccttacaggttatataattaaagctctgttgacattggctcttgaaggcaaacttcataatgaggggaagagtcaagttttgtgtaacctgaagcatatacagtgtccattgccagcacttgagtaaagataaagagtaggagaatcaaagctgttgtataattagttctcttctcatccacacccataaaccagttcaagaaagggatgaaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgaggaagaatattaagttactgaagtgtatatgcgtagggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggccatttcg

SEQ ID NO: 30238 - DNA, 1568 bp, Homo sapiens
ccttccatctgctcttccatcatgcaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgaggaagaatattaagttactgaagtgtatatgcgtagggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggccatttcg

SEQ ID NO: 30239 - DNA, 551 bp, Homo sapiens
gtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaagtaagcattttcaccagagctgtgggttagatgtcacatggcagaagcagccagattagatccacttgtcgtgggcattaagggggcatctttcctttatggagctgaaggtgagcatatattggccatcattctgaaagcatatggtttggggaggctgatgataagagagtgctcttaaggaattaattacagttttgtctttgactttaaccatgttgaaaattaatctagtaaccttataggaaggctgatctttagagtaataatagttactactaccaaatactaaataaatactaaggctttttctttat

SEQ ID NO: 30240 - DNA, 429 bp, Homo sapiens
ctgaatatctttggtagggcagaggtaccaggaatggggtcaccgtctaacacaggcaaaggtaagctccctggataagtccatgctgtcacctgtactcctaattccattccctccaagttgacttttcagagctgaacttctaaccttgcgtgtcagtatttggggtcctgacacctctctctagggcatatgccccggccagctccactgtgcctggaagagacttcactcctttcctttctcagatgccattgagagaagcccaagcacatgaataacctgacttaggtgaccatgaggcagtgaagtgtccccgagcatcgtggcataggggcttggatggcccatacgcagttctgtgaccatcactgggagccacagctccaaggccacttctctccatcaccttacagagagctggaaact

SEQ ID NO: 30241 - DNA, 3130 bp, Homo sapiens
atcagaaaatggaaccccctttgtcgtgaaaccgatcaagcattttgacaggaagcccttcattattcataacattgtatgctgaccaagacgtcagaagaccacctgtgcccttttctctcgtggaagataaaacctggactcagggagcaaccacaggctctccactttgaaactttagtttgaattttaaaagataggaagtaatacagtttaagttcctttctcacactcagtattgcatgcttagtgctggttttcttacaacattttggcaggtgtagctttttctgttaaaaatggtatacatgaagtcacatacttttttaaaggaacactcagaacattctgtcattccagtcagaaactgtcttttgaaatatttctttacaacctaccaaaaaaggaaggttgttttttctacatgtgcttgggtatctaacatctaccattaaaacaacaaatggcttgcagacagggcagtaatggtttatcctaaattactcaaccccttgtagccttgacaaattttaccttaaaaccaaaatgaaacacaaaaattaatccttaataatgatagcaagtgatctttctttttagttttagccttcctttttcaatagtaatatttaaacccacttttgaccaattgtttgcccaaatattcttgtcatttggagtcagtggaaaatccagcacaccaagcaccagtcttcttctgaggcaaaagaaaagtgttgtcattttcactctgttggagctgcacacttttttttctttttttttctttttttttttgtcgtgtaagaaggatgctggtcagagctgcagaaaatatgaggcaattaaaagtctttagctgttagcaaacctgttagttttacttctgcattgaaccagcctcagaagctacttactgctttatgtactctttgggcattaatgccttctctgtaattatatctcgtttttgcttgacagtgacctacccaataattgcatcgtgcattgccatgaaaggtaaacacattgtgaactgaacttaccaagcagattctgtgagaaagcactggttgaggctgaacactgttgacacatcatttttattggaagagtattaactggtgcctcttctgaaacacaccaacccatattcctctgctcccccaaagctgtttctgatcctgctgggagcaactaactagttattatgcacatctgctccagacccagctctttaacttcatggttttacagcttgttttttctttttcttttcttttctttttttttttaaaaaagcacctttttttgttgtttccccttaataaaagaggtttctaatttatgtttctctaagatttcctttggttgtatttagaaacacaaatagttttataatcaggattgcatttgtgctgggtaaaagaggagagctgtgctttctaccccaaagttgttggtaatggagccggtctgcccttcctacaaactcaagaggctcattgttcaaggtgtaacaacatttaattgcatgtcctctaacgctttgaaacctttagagggaagatcctcattttttacaattttgttccttttcatcatagaaaacatgtttaagataaaatacaaactttacctaccccaaattcataaagtacatttagtgctgtatagcactaaaacttagagatacagacactgtacttactttttaagaattagagacagtaactccaaaaataattgtccttttttctttctttctttttttacaataaggctcttgaaaattgtcattacttgtgttttcctatacattcatctgtgtgaaagcctttttcttctttgatttaaaaaaattaactatacagttaatggtttagaacttagaactacttagaattaatgctaaagtgtcaggaagaaattaatttagcttcaataattgtgactggcctcaggaattctcccttccacacctgcccacctcacctcactgcaccgcaccgcaccagagccagagcagctgcttgtctgcagcaggacacagttcctacatacgtttcagttctttcatggtaagctcaatggactttgaattgtttacagtgctgtatgtccaattgttaaatgtaccattctgaacgatgttaaagcaagtgtggtttatttatggcatgaaccatgtaacttgaaatatgaacttacaaggaggggcactcattaggtaacaagttcttacaccaaacttccttgatgaaataagccaaaataatcctaaaattcattagaagaacttgataaaagactcaaataaatgttagaaagagcccgtaattttaggactcctataaaattcttccttgtttgttaatgctattaaaactcagattcaagggaaataccagcttccacttgagtcactttgaaatagttaattcaacagcaccatgttagaaatatattggcagccaagactctgaactctgcagaaacatttgtttcacccagacttcaaactctagccctgactatgatgcccctgtgtgcatttacaataaagactccaacggagggagcctgttggtgttaaattgtttacatttctttatacaaataatgtgctttcagtgccttagttacagctccctttctgtttcttgttccaaggattctgtagtatgtagtgtgtttcttaggtaaagtctctttttgctactgaaagggaaatggtctctaaacactggtcactgtagcaggtaaacactactctaacgtggagaaatgagcttcatgctgaggtagtggttgccttagagctgttatttatgctgtagaaaacgaaaatggttttgctacctgataagcttcagattagatatagccctaaagttatcctgtacctgcattaaattttcattttagaagagaatcttggttttggtaattcatttttttttaagatcattatgtgcaaaacaccaagttttaaaaataactcacagaatggccttagttttcaatgtctgatggtatatttgtgagttgtgttatctgtaatatacatcccagaataaaggagtgaattaaatagtttaaaaaaaaaaagaaagttggggtaaaaaaa

SEQ ID NO: 30242 - DNA, 705 bp, Homo sapiens
atggagatgggcagacggattcattcagagctgcggaacagggcgccctctgatgtgaaagaacttgccctggacaacagtcggtcgaatgaaggcaaactcgaagccctcacagatgaatttgaagaactggaattcttaagtaaaatcaacggaggcctcacctcaatctcagacttaccaaagttaaagttgagaaagcttgaactaagagtctcagggggcctggaagtattggcagaaaagtgtccaaacctcacgcatctatatttaagtggcaacaaaattaaagacctcagcacaatagagccactgaaacagttagaaaacctcaagagcttagaccttttcaattgcgaggtaaccaacctgaacgactacggagaaaacgtgttcaagcttctcctgcaactcacatatctcgacagctgttactgggaccacaaggaggccccttactcagatattgaggaccacgtggagggcctggatgacgaggaggagggtgagcatgaggaggagtatgatgaagatgctcaggtagtggaagatgaggagggcgaggaggaggaggaggaaggtgaagaggaggacgtgagtggaggggacgaggaggatgaagaaggttataacgatggagaggtagatggcgaggaagatgaagaagagcttggtgaagaagaaaggggtcagaagcgaaaatga

SEQ ID NO: 30243 - DNA, 453 bp, Homo sapiens
caactcccttcactgggctgcttttgacccagaacattcaaagctactgtggaaccacaatcagcagatcctaacatgcttcttgcaaactgatgcacattttttaaactatctgtgaatcccctactacttaccttaattgaaaatgactgatacagaacttcccagagtctctttcctcttttctctctcacttatttcgttctctgcacaaaaaattttggaataaatgaaatgcatttttctctgcataatttctctctgtttaacagtgaccacacatctttgatttttgtcactgaactttcaaaggtctttgcataccatgggttgacaatgtcagtcaaaggacaatttacaagcatatttcttcactcttctatgaaccaatttgctgaataatttctttttttaaaaggtatgaagtgtacagtagatgctcagtagatattt

SEQ ID NO: 30244 - DNA, 379 bp, Homo sapiens
accatgctggtgaggcgcctggactccagtcagataacccagcatcaactctgctgtgacccttaccagctgtgtgactttgggcaacttatttaacctacctatgcctgttttcttcatgtataactaaaggtgatagtgaacctaatgaggattaaattgcgcaatgaataagcacttaccacagtgcctagcatagtaaacatttaatacatgtattaaagaattgggagcaatggtcttgcaaccttttccacaacccccccagccctttaattcaggaaaacctgcctaaaaatgaaggcccaaagtgtaaggcacaataaaaacaataaaagtgggagcccttgaatagagtggggtagggagccttggctcc

SEQ ID NO: 30245 - DNA, 1314 bp, Homo sapiens
acagggccataaagctcatatggagtaccctgcaaaaatgttgaaagctgatactgaatatttactcaatttgtgaaaataatataaggaaaattctgcccaacatcccaagaagtttcaagaaaaccttccgtcagctcactaagctttgtgcaagtgtgccatctgaattcataattacatataaaatagggggacctcaaataaaagcattaagttaaaaactgttacgagatatgtgaaacttctaaggttctagcagaatcaaatctaaaactactatctaaggagatgtccgtaaacccaacttataagatgcctccctatcaaagaaccctaccactaccaccatctacaaactgaagttatctaataaccaaaatattatgagaaacataacaacagcacaaaaaaatgagtagcggcagcaaatggggaaacatgaaagtcagaagctcaagaattggagataacataataatttgaacaaggctattatgaaaatacattttaaatcattaaagatgtttaaaaagtaatagaaaccaggccaggtgcagtggctcacaactgtaattccagcacattgggaggctgaggcgggtggatcacccgaggccaggagtttgagaccagcctggccaacatggtgaaatgctgtctctactaaaaatacaaaaattagtcagggagggtggtacatgcctgtaatcctagctacttgggaggctgaggcaggggaatcacttgaactcgggaggcagaggttgcagtgagctgagatcacaccattgcactccagactgggtgacagaatgagaccctgtctaaaaaaaaaaaaaaaagtaatagaaaccaaaatggaaaaaaaaaaaaaggacagtaaaggaaaaaaaagatatgtgcatttgagaaaaaaatgaaatcacatacttggaaatgaaaattgtctttgaaattaaaaactgagcagatcagttaaacagcagattcaatatattcaaggaaacaaagagtgaaatggaatttagatttgattaaatcacacagaacacaacacattatgtgtgtttggaaaagatggatgaaagcctaaaaggtatgatggatgcagggaagtggagaggttcagtacatatctagtaggagtcccagtgagagattataaaagagagagtatatgcaaaagtaaataactagaaattttttagaatttaataaaaacatgagatttcagattgaaggaatgcattgagaccactgcaggatacacagaatcaaatacacacctagaaatatcatcatgacaataaa

SEQ ID NO: 30246 - DNA, 1260 bp, Homo sapiens
acagggccataaagctcatatggagtaccctgcaaaaatgttgaaagctgatactgaatatttactcaatttgtgaaaataatataaggaaaattctgcccaacatcccaagaagtttcaagaaaaccttccgtcagctcactaagctttgtgcaagtgtgccatctgaattcataattacatataaaatagggggacctcaaataaaagcattaagttaaaaactgttacgagatatgtgaaacttctaaggttctagcagaatcaaatctaaaactactatctaaggagatgtccgtaaacccaacttataagatgcctccctatcaaagaaccctaccactaccaccatctacaaactgaagttatctaataaccaaaatattatgagaaacataacaacagcacaaaaaaatgagtagcggcagcaaatggggaaacatgaaagtcagaagctcaagaattggagataacataataatttgaacaaggctattatgaaaatacattttaaatcattaaagatgtttaattgggaggctgaggcgggtggatcacccgaggccaggagtttgagaccagcctggccaacatggtgaaatgctgtctctactaaaaatacaaaaattagtcagggagggtggtacatgcctgtaatcctagctacttgggaggctgaggcaggggaatcacttgaactcgggaggcagaggttgcagtgagctgagatcacaccattgcactccagactgggtgacagaatgagaccctgtctaaaaaaaaaaaaaaaagtaatagaaaccaaaatggaaaaaaaaaaaaaggacagtaaaggaaaaaaaagatatgtgcatttgagaaaaaaatgaaatcacatacttggaaatgaaaattgtctttgaaattaaaaactgagcagatcagttaaacagcagattcaatatattcaaggaaacaaagagtgaaatggaatttagatttgattaaatcacacagaacacaacacattatgtgtgtttggaaaagatggatgaaagcctaaaaggtatgatggatgcagggaagtggagaggttcagtacatatctagtaggagtcccagtgagagattataaaagagagagtatatgcaaaagtaaataactagaaattttttagaatttaataaaaacatgagatttcagattgaaggaatgcattgagaccactgcaggatacacagaatcaaatacacacctagaaatatcatcatgacaataaa

SEQ ID NO: 30247 - DNA, 515 bp, Homo sapiens
acattaaatgtacatgcaaatttttagcaaggttgtgcctaatcaccaccatgaaaacttctttggaatatgagccttggtgtttaccagtagggaaatgacaggttgttcaaaaggaaatgtttcccaagttctggttggaagctggcatcagagaaagagggaaatctagaactgttcttagtttctctagcaacaagatttcaaaaaattgtactgaaagttcagtgaacattgttacagggatttccattcttcataaaaagaataaacttgcaaaaactgagactgaatgatttagcaattgaattataaaagatcaatgttggatattctgtgttttaaaacataataaaaattagattagtttaatttgaattcgagacactaagtgataaagttacatgttcagtatttgaagctgtagctttgcataagcaataaataattaataggattttgaaacttggtccaagcatataaaatagtgcaaataccaagaaatagcatgcaaa

SEQ ID NO: 30248 - DNA, 780 bp, Homo sapiens
gccacatgaaactggcattttaaattgaagtgcattaactggatagtcctaatcaataagcacgtggtttgtgtccaaagagtattttacctacgtgacaaaataaatattacatttaggtttcattatgcctttcttgtaaagactgattttccattttataaggtaaaatgcttgtgaaacttgatgcagaatatttgactacttgaattcagcagaacatactacatatttttctttgtagacatttttggcagtttcattctttaagaacaagtcgagaagtagataatcttctctacccaaattttttaccttttgagaaaaaatatggatttaaattatgagcaatattaaactctcattacatcatcagaaatctgggagctaaagtttatttcagaagtcttattagatggagttgcatttcttaaattaggagttatgttttatttaaatttcctgcctacccttggagttgtaaacatcaccttacttcataaaaccttccctgaagtgcctcgtagtttcccatctctctgtgcccatgtggagatactgctatttcttgtcttttatccaaatgggcctgaaaattcagagtgtagccacagtaacttctgtgctgtgaatgcatatggcttggatcccaagtagagcactcagtctgccttgctctttgatatcaattataatctattaacataactaaaatcccatatatggactcctttggctgttttcaatcttaaagccgtttatggtagaacttttcatgta

SEQ ID NO: 30249 - DNA, 753 bp, Homo sapiens
accctacatgctgcgcctatacccaggaccgatggtaactgaggcggaggggaaaggagggcctgagatggcaagtctgtcctcctcggtggttcctgtgtccttcatttccactctgtgagagtctgtgctggaccctggagttggtggagaaggagccagtgacaagcagaggagcaaactgtctttatcacactccatgatcccagctgctaaaatccacactgagctctgcttaccagccttcttctctcctgctggaacccagaggaggttccagcagcctcagcaccacctgacactgtctatcatccacactgcagcaaggtgattctgccaaaacatatctccttaaaagccaactggagcttctcatcagcatcaatgtgaagccaaaaatccttaggaggacagagggagtccctcacaacctagactggtccccttccctccagctgcctcaactgtccacaggactctcttcccacctgcggccacactgtgcaacctggaatttccccacctgggcggactcatcacgtcatcaccaattggatgcatcttctgctctgtgcagctggtgaaatctttctcaacccttgagatgcagcccaatcttctcctaacatctggattcctctctgtcactgcattccctcctgtcatcctgcctttgttttcttgccctcctttctctcccgggtgacaggcattacctaaaattaaataaaaattcagatcatccttgcaaat

SEQ ID NO: 30250 - DNA, 496 bp, Homo sapiens
tggccagcgactacccactcacgcgtattgcgccagattgcgtattatctatcatccacactgcagcaaggtgattctgccaaaacatatctccttaaaagccaactggagcttctcatcagcatcaatgtgaagccaaaaatccttaggaggacagagggagtccctcacaacctagactggtccccttccctccagctgcctcaactgtccacaggactctcttcccacctgcggccacactgtgcaacctggaatttccccacctgggcggactcatcacgtcatcaccaattggatgcatcttctgctctgtgcagctggtgaaatctttctcaacccttgagatgcagcccaatcttctcctaacatctggattcctctctgtcactgcattccctcctgtcatcctgcctttgttttcttgccctcctttctctcccgggtgacaggcattacctaaaattaaataaaaattcagatcatccttgcaaat

SEQ ID NO: 30251 - DNA, 522 bp, Homo sapiens
  misc_feature (79)..(79): n is a, c, g, or t
  misc_feature (83)..(83): n is a, c, g, or t
ctaggcaacatcactgcactcccacctacccgccacccttctaccggcacctaccaccaaccgtgagtccgctcaaccnccanacatgcgatttaggtgattctgccaaaacatatctccttaaaagccaactggagcttctcatcagcatcaatgtgaagccaaaaatccttaggaggacagagggagtccctcacaacctagactggtccccttccctccagctgcctcaactgtccacaggactctcttcccacctgcggccacactgtgcaacctggaatttccccacctgggcggactcatcacgtcatcaccaattggatgcatcttctgctctgtgcagctggtgaaatctttctcaacccttgagatgcagcccaatcttctcctaacatctggattcctctctgtcactgcattccctcctgtcatcctgcctttgttttcttgccctcctttctctcccgggtgacaggcattacctaaaattaaataaaaattcagatcatccttgcaaat

SEQ ID NO: 30252 - DNA, 380 bp, Homo sapiens
acttgcccaaagttgacgctagtaagtggcagagctaagcctagactctgggtcttaagcatagttcaaggcgctttccacagagtgtagatggagtttcacatttttcatccagattccttaaggacctgaacttgctaatttgatctactaacctggaaattgactagggcttctcttataccactcagccctttaaagttttgccagtaaagtatcaacatggttaataatatgctgtaatttagagcacacaagccaatggacatacaaatttggtcattcagtagccacccagagagtgagcacagatacacactggagcagctgatttggcaagattggtggaggctgaacatattaactagtcattaaatgaa

SEQ ID NO: 30253 - DNA, 709 bp, Homo sapiens
gcacttatcaccttttcaacatactatacactttacctatttatcttgttaactgtccatctcctccaaccagaatgtaagctcagtaggagcaagaatttttgtctgctttaatcactgatacatcttgtctccagcacctaaaatgtaggggctcaacaagtatttgttgaaaagtcagtaaatgagtgactgattcttaaagacctttttgtaactccattttagaagaccaaagaaaaaaagacaaaatcttgaacattaatatttatacaaaccaaatactactttttgtaggtaaaatatgattctattgtgatgtaaagttacctttttgactgtagtgaaatccatgaatggcaaggatctaactaatttactattgctcctcttccaggaaatgtttcaactttcaaataaagaggacttctgattgtcaagcatggcaaattcatgtggaatgcctaaaaatgctgagtactaaaaatatttttaaagatatggctaagcagcaagaaagtaacagcaattgttaaaagttgaaaatgacaaggaaattagaacctagagaagtaagtaggtaagtcctgcataagtcaatccctgatggggatattaagagacaaagggacagcctaatgtccacacaggaaggtcaaagccaatacccttgaaagatgaaatcctcagtgggtaaattaaaaaaaaa

SEQ ID NO: 30254 - DNA, 393 bp, Homo sapiens
gaaaataactggtagtggggctccttggctggagtagtcatggagggtctctagaggatgacttgccatctgatatgtctgaaggacagagctgagccagccccttgaagtgcttgacaatgactggctcaggcagagggaacagcatgaacaaaggcctcagggcaggacaaagcttagcatgtttgggtacagaaagaaggccaaagtgggaggggagaaagaggtggcaagaagaaattaagataatcagaatctcttttcattgctctgtgggagaaaaaggctttagatttgtcattcgtccaatgctgtgtatgacagttgcttctagtgaccctgcagtctttgagtctctttttgctttgggaggctgaaacaatgtttctttct

SEQ ID NO: 30255 - DNA, 4646 bp, Homo sapiens
agcggagcgggacccgcggctcgggatggaggctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccaacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatccaaaaaaaaaaa

SEQ ID NO: 30256 - DNA, 352 bp, Homo sapiens
  misc_feature (316)..(316): n is a, c, g, or t
ctttcttttatttctgtgttgtgttcttttatgttatttgcttgtttgggaggggttgtgtttaagtttaactcttgtagcacaggccagctggatttaggatggactctagcttctgtgtaccaaagtcgtcctgttgaggggtttgggaagatactccccagtcatcaaacacagtccctcagagcaagtcacgttgtcatttacctgcatttgcagagctccctagggccgtgactgagacctgtccttcctgtctttttcagattgtgggctgcacactgcaggaagattcagctgaagaaagataactctnccatacaagtgtagaactaccaacgctgcgccctaa

SEQ ID NO: 30257 - DNA, 148 bp, Homo sapiens
tcaggtcttgcctggcagctcaggtactggggctagggtgtctgctatgcctggtatacatgcggcttcattgccaataaatttcatgcactttaaagtcctgtggcttgtgacctcttaataaagtgttagaatccaaaaaaaaaaa

SEQ ID NO: 30258 - DNA, 4765 bp, Homo sapiens
agcggagcgggacccgcggctcgggatggaggagtctcactcttgttgcccaggccgcagtacaatggcgtgatctcagctcactgcaacctctgcctcccgggttcacatgattctcctgcctcagcctcccgagtagctgggattacagctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccaacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatccaaaaaaaaaaa

SEQ ID NO: 30259 - DNA, 5543 bp, Homo sapiens
agcggagcgggacccgcggctcgggatggaggagtctcactcttgttgcccaggccgcagtacaatggcgtgatctcagctcactgcaacctctgcctcccgggttcacatgattctcctgcctcagcctcccgagtagctgggattacagctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaaggtgagtcccagtaacctgggaggtggggtgggggatggatgcctctttactgtgatttccattcgttgttgaacattttccttagctgagctattttttgtccaaagataatcatgattaatatctggtatcattttaggcccctctcaatcttagttttctaatctgcttttttcagcgaatacattataaacactttcccacaaacatgatttaaccagcctgagcaacatagtgagacccatctcacaaaataataataggctgggtgtggtggcttacgcctgtaatcccagcactttgggaggctgaggcaggtggatcacttgaggccaggagttcaagaccagcctagcaaacatggtgaaaccccatctctactaaaaatacaaaaatcagctggggggcgtggtggtgtgcacctgtagtcccagctactcaggtggctgaggcacaagaatcgcttgaaccctggaggcagaggttgcaatgagccaagatcatgccactgcactccagcctgggcaacagagcaagactctgtctcaaaaaacaaaacaaaacaaaacaaaaaaccccacttataataataataaagataatttttctgccataataacagatctaaaagcatagaggcaactaccatattgactactttctaattccatttgattcatgttttcactgggaatttggagaaaatcaacccagaagcctactggttattgacttggagttgggtaggaacctagcctcgggtttatcctgcttgcagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccaacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatccaaaaaaaaaaa

SEQ ID NO: 30260 - DNA, 4593 bp, Homo sapiens
agcggagcgggacccgcggctcgggatggaggctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccaacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcacttta

SEQ ID NO: 30261 - DNA, 4601 bp, Homo sapiens
agcggagcgggacccgcggctcgggatggaggagtctcactcttgttgcccaggccgcagtacaatggcgtgatctcagctcactgcaacctctgcctcccgggttcacatgattctcctgcctcagcctcccgagtagctgggattacagctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagagcttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccaacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatccaaaaaaaaaaa

SEQ ID NO: 30262 - DNA, 5048 bp, Homo sapiens
agcggagcgggacccgcggctcgggatggaggagtctcactcttgttgcccaggccgcagtacaatggcgtgatctcagctcactgcaacctctgcctcccgggttcacatgattctcctgcctcagcctcccgagtagctgggattacagctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcaccgtgagtggggctactctgtttgaaatgctctcctctcttccatccccagccaccatttccttctctttgttctggtttctcgtatagagttcctggcttctgttctaacgttttacaaagggccagttctattttcccttgctcaattatagtgcaacatgctttgcatgatagggacagactaactagcaacttatctgtccctcagtacctcttagctttgaaagcattgtgttgatgtcagaaatgactgaattttgtgcaccctgatggtagccgtttatatcgaattctaactcctacaatagctctctaattcacttttgtttctccccatcttgtcaagtggatagaccactggcaacaagacagtttttgttttccagcttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccaacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatccaaaaaaaaaaa

SEQ ID NO: 30263 - DNA, 3793 bp, Homo sapiens
ctactactactaaattcgcggcccgtcgactagctttgaaagcattgtgttgatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagagcttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccaacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatccaaaaaaaaaaa

SEQ ID NO: 30264 - DNA, 4580 bp, Homo sapiens
gggtatctagaggatccctttgcggtgcctttcaacagaactttatgtgtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcaccgtgagtggggctactctgtttgaaatgctctcctctcttccatccccagccaccatttccttctctttgttctggtttctcgtatagagttcctggcttctgttctaacgttttacaaagggccagttctattttcccttgctcaattatagtgcaacatgctttgcatgatagggacagactaactagcaacttatctgtccctcagtacctcttagctttgaaagcattgtgttgatgtcagaaatgactgaattttgtgcaccctgatggtagccgtttatatcgaattctaactcctacaatagctctctaattcacttttgtttctccccatcttgtcaagtggatagaccactggcaacaagacagtttttgttttccagcttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccaacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatccaaaaaaaaaaa

SEQ ID NO: 30265 - DNA, 4343 bp, Homo sapiens
ctactactactaaattcgcggcccgtcgactagctttgaaagcattgtgttgatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcaccgtgagtggggctactctgtttgaaatgctctcctctcttccatccccagccaccatttccttctctttgttctggtttctcgtatagagttcctggcttctgttctaacgttttacaaagggccagttctattttcccttgctcaattatagtgcaacatgctttgcatgatagggacagactaactagcaacttatctgtccctcagtacctcttagctttgaaagcattgtgttgatgtcagaaatgactgaattttgtgcaccctgatggtagccgtttatatcgaattctaactcctacaatagctctctaattcacttttgtttctccccatcttgtcaagtggatagaccactggcaacaagacagtttttgttttccagcttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccaacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatccaaaaaaaaaaa

SEQ ID NO: 30266 - DNA, 4592 bp, Homo sapiens
agcggagcgggacccgcggctcgggatggaggctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccaacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaacagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatccaaaaaaaaaaa

SEQ ID NO: 30267 - DNA, 2476 bp, Homo sapiens
gaagcagagatacggagtgagcgagtcatacagagaatcccagcgtggtatatgccagaagatggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccaacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatccaaaaaaaaaaa

SEQ ID NO: 30268 - DNA, 1219 bp, Homo sapiens
tgcatcataatgtcagaacatagaggatccacatgctgctacaccgctagttgcatgcacatcgccaaagtggaatttcgcacatgctgcgaaatgagcccatgtacaccgccgtttacctaagctgtggagtccacctcatcatctcgacctgcatgcatagcagcgctacgctacaaggatttcttttaacaacgttcttgaattggaaaaacccttgcggactaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatccaaaaaaaaaaa

SEQ ID NO: 30269 - DNA, 220 bp, Homo sapiens
atcaccccactgcagcttatgaacaacggtcatccctgtcttctcacttcaggtgctaaatgtgtgtccaaggagattgttaggaccagcctcctctgaatcagggcagctggacacttgggagggaagacagctggagagtatggtcacagcagcatcctcctctgttttctttcctagataactcttccacacaagtgtacaactaccaaccctgcga

SEQ ID NO: 30270 - DNA, 333 bp, Homo sapiens
atgagagtaacctggttcctcttccctgctctgggacaggtacagccaagctgatgctctcaagtacgtggggatcgagagggagaccgacgtcctttagccctcccaggccccaacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatg

SEQ ID NO: 30271 - DNA, 492 bp, Homo sapiens
agctgggattacatgtgtgtaccaccatgctcagctaatttttgtattatgtttttgtagagatggggtttcaccatgttggcctggctggtctccaactgacttcaagtgatctgcctgtcttggcctcccaaagtgctgggattactggcatgagccactatgcccagccaattttggaaggaaattacatttctttcttgggttatatgcccgtctttccctctccatgtcattgcttatatttcagtgtaccatagagagcattttcccgggatttgcaagccaacatatgttaatgaggtcactgaacacagttgcattggttcccatcatgtattcctggtcccctctccaacagaactttatggtatgtattgaaagcactgtggtggttatttaaactgtatgattgtgttatgttgatatgccagagctcctcttagggtaaagattgtccagtaattaacacagctaggacatgcagggcag

SEQ ID NO: 30272 - DNA, 3143 bp, Homo sapiens
tggcgtaagaggcggcggtggaggcgctacgctggcgtaagaggcggcggtggaggcgctacgctggcgtaagaggcggcggtggaggcgctacgctggcgtaagaggcggcggtggagacgtttcgctggcgtaagaggtggaggtggagacgttacgctggcgggcacgatacaactgcagctgcaataaactggtccttatacctgttgggttctaacccagaagtccagaaaaaagtggatcatgaattggatgacgtgtttgggaagtctgaccgtcccgctacagtagaagacctgaagaaacttcggtatctggaatgtgttattaaggagacccttcgcctttttccttctgttcctttatttgcccgtagtgttagtgaagattgtgaagtggcaggttacagagttctaaaaggcactgaagccgtcatcattccctatgcattgcacagagatccgagatacttccccaaccccgaggagttccagcctgagcggttcttccccgagaatgcacaagggcgccatccatatgcctacgtgcccttctctgctggccccaggaactgtatagtaatttgaaggtcaaaagtttgctgtgatggaagaaaagaccattctttcgtgcatcctgaggcacttttggatagaatccaaccagaaaagagaagagcttggtctagaaggacagttgattcttcgtccaagtaatggcatctggatcaagttgaagaggagaaatgcagatgaacgctaactatattattgggttgtgcctttatcatgagaaaggtctttattttaagagatccttgtcatttacaatttacagatcatgagttcaatatgcttgaatcccctagacctaatttttccttgatcccactgatcttgacatcaagtctaacaaagaaaaagttttgagttttgtattttcttttttcttttttctttattttttttttttgaaaccgtgtctcactctgtcgcccaggctggaggagtgcagtggtgtgatctcagctcactgcaacctccacctcccaggttcaagcaattcttctgcctcagcctcccaagtagctgggattacaggtgcctgccaccatgcctggctaatgtttttgtatttttagtagaaacagggtgtcaccatgttggccagactggtctcaaactcctgacctcaagtgatccacctgcctcagcctcccaaagtgctgggattatagtcgtgagccaccacgcctggccagagttttttatttttatcaccaccatagatgttacagttggctgtggtcacaaaagtagttaattgtgtcagcacccaaataaacatctaacaggtttctcaacagaggaatccacagtccaattccacttcaattgatagacccaaaaaatataatttaatcaaagttctagagtttttgtttgtttgtttgagatggagtcttgctctgtcgcccaggctggaacgcagtggtgacatctcggctcactgcaacctccacctcccaggttcaagtgattctcctgcctcagcctcctgagtagctgggactacaggcgcctgccaccacgcccagctaatttttgtatttttagtagagatggggtttcaccatgttggccaggatggtcttgatctcttgacctcgtgatctgcctgcctcggcctcccaaagtgctggcattacaggcatgagccaccatgcctggcccaaagttctagaattttttaaaggtattcatggtgactcaggaatacacacatacacacacacacacacacacacacacacacacacacacatacacacacacatataatttgaaagaggtgagtatgtactctgacttcagctctcaggttttaaaaattatattagtgggaccagttatgacaagaataatcattatagtacttttcagattttataacctggagcagattattttaagttgattagtaggttctgttacagtttttcttttgatcgtgcacttatagtcttcatttaattcctcatagaatcccagtcacctttatatatcatattattggaagagattcatcttcataatctccagttttttcacagtgcctcacagagttaatcatgccttttggagctagaaggactttagaacttatctagttatgctcctttatattataagtaagggaatagaatcaataagacagtttctgcccaaagtcatgttaccagttggtgacagagctggaaatacgtagagatctatacccttaaatctctccactcacatgctgatatactttctactacaatatgctatagctttatggaactcagggtgatgatcagacgtgtcattagaacatgagtcctctgcttctgattcaggcatacttttgggattcttccatctttaaaggaaaaaggaagccattcatctatatttagtaacccagtaatatctcacttagtttagggttagatctttagttaattcaaccttatagatcatacttatgaaggtgataactgacacgtgttccctgaattttaatttgataggcaatacatctacccactccattattttttaaaacttcatttaatagtttaaacaagattggttttgttttcaatttttattcactcttcatagaatcacaattacctttatatatcatatgttattggaagagattcctcagtaatctccaatctctcatagtgcctcacagggttggtcaatggcttttggaactggaaggaccttagaacttatctgttatgctcctgatagccaatagcagatagaagcttgcaatcaagagggtaggacatgtgttcttcaatggatatcaaaggaagaggttgcaaaccaaagccatttggcaagccctgtagcctgggccatttaagacaggggcggtctcagccaaattgcacccatttaactatcccaaagagccacagtgcctacaacccaggccctaagttgatgaagaaaaagtcaaggaaggaggtgatacaattggaaatattcccatcaaatggttaatcttatttagaaaatgggcatattagaaaaagtccttccaagatgattttggataataaaagttgtatttgtgga

SEQ ID NO: 30273 - DNA, 486 bp, Homo sapiens
gatgctgccttgttttataagaagatgatcaaggtgtgtgtgcccattacctctcctctgcctgaaagacgtgtctcaagaaaaataaattctattttagatgcaggtactgcatttaaaatagaatttatttttcttgagaatgtctttcagctccagaattattgttactcatattttaatcagtaagtcatttaagctatgacagagtaggaattgagaaattatttcatatgctacagtattgaaatgtggatgctgccttgttttataagaagatgatcaaggtttgtgtgcccattacctttcctctgcctgaaagacgtgtctcaagaaaaataaattctattttagatgcaggtactgcattttattctaagaattgatatcaattcaaaacatagaaaactgtaaaagataaatcaggagatggctgattcataatgggtaataaaataaatagcactttcgagctgaaaacgtcag

SEQ ID NO: 30274 - DNA, 479 bp, Homo sapiens
agccgtccccagccatggtgctcacacataggcttttgagctccttggagctatccagatcctgctcacttttccttcctgagatcaaaacaaatttcaccccctactcccactccaaacaaggccttgatgataaactaatccttcctaaaatgctggtaggtaaacaagcaatgatgaagcattgaacacaggttaactcctgacttttgtaccattgtctattccattacacattaacatgaccctgctgccctctagcagccaagctcagatgagttccaaattgcacccatttaactatcccaaagagccacagtgcctacaacccaggccctaagttgatgaagaaaaagtcaaggaaggaggtgatacaattggaaatattcccatcaaatggttaatcttatttagaaaatgggcatattagaaaaagtccttccaagatgattttggataataaaagttgtatttgtgga

SEQ ID NO: 30275 - DNA, 3512 bp, Homo sapiens
cagaggtactggtcactcctaatcatcgcagcataactctgttttaagctattgttctctgcatttgtaggggcacgatacaactgcagctgcaataaactggtccttatacctgttgggttctaacccagaagtccagaaaaaagtggatcatgaattggatgacgtgtttgggaagtctgaccgtcccgctacagtagaagacctgaagaaacttcggtatctggaatgtgttattaaggagacccttcgcctttttccttctgttcctttatttgcccgtagtgttagtgaagattgtgaagtggcaggttacagagttctaaaaggcactgaagccgtcatcattccctatgcattgcacagagatccgagatacttccccaaccccgaggagttccagcctgagcggttcttccccgagaatgcacaagggcgccatccatatgcctacgtgcccttctctgctggccccaggaactgtatagtaatttgaaggtcaaaagtttgctgtgatggaagaaaagaccattctttcgtgcatcctgaggcacttttggatagaatccaaccagaaaagagaagagcttggtctagaaggacagttgattcttcgtccaagtaatggcatctggatcaagttgaagaggagaaatgcagatgaacgctaactatattattgggttgtgcctttatcatgagaaaggtctttattttaagagatccttgtcatttacaatttacagatcatgagttcaatatgcttgaatcccctagacctaatttttccttgatcccactgatcttgacatcaagtctaacaaagaaaaagttttgagttttgtattttcttttttcttttttctttattttttttttttgaaaccgtgtctcactctgtcgcccaggctggaggagtgcagtggtgtgatctcagctcactgcaacctccacctcccaggttcaagcaattcttctgcctcagcctcccaagtagctgggattacaggtgcctgccaccatgcctggctaatgtttttgtatttttagtagaaacagggtgtcaccatgttggccagactggtctcaaactcctgacctcaagtgatccacctgcctcagcctcccaaagtgctgggattatagtcgtgagccaccacgcctggccagagttttttatttttatcaccaccatagatgttacagttggctgtggtcacaaaagtagttaattgtgtcagcacccaaataaacatctaacaggtttctcaacagaggaatccacagtccaattccacttcaattgatagacccaaaaaatataatttaatcaaagttctagagtttttgtttgtttgtttgagatggagtcttgctctgtcgcccaggctggaacgcagtggtgacatctcggctcactgcaacctccacctcccaggttcaagtgattctcctgcctcagcctcctgagtagctgggactacaggcgcctgccaccacgcccagctaatttttgtatttttagtagagatggggtttcaccatgttggccaggatggtcttgatctcttgacctcgtgatctgcctgcctcggcctcccaaagtgctggcattacaggcatgagccaccatgcctggcccaaagttctagaattttttaaaggtattcatggtgactcaggaatacacacatacacacacacacacacacacacacacacacacacacacatacacacacacatataatttgaaagaggtgagtatgtactctgacttcagctctcaggttttaaaaattatattagtgggaccagttatgacaagaataatcattatagtacttttcagattttataacctggagcagattattttaagttgattagtaggttctgttacagtttttcttttgatcgtgcacttatagtcttcatttaattcctcatagaatcccagtcacctttatatatcatattattggaagagattcatcttcataatctccagttttttcacagtgcctcacagagttaatcatgccttttggagctagaaggactttagaacttatctagttatgctcctttatattataagtaagggaatagaatcaataagacagtttctgcccaaagtcatgttaccagttggtgacagagctggaaatacgtagagatctatacccttaaatctctccactcacatgctgatatactttctactacaatatgctatagctttatggaactcagggtgatgatcagacgtgtcattagaacatgagtcctctgcttctgattcaggcatacttttgggattcttccatctttaaaggaaaaaggaagccattcatctatatttagtaacccagtaatatctcacttagtttagggttagatctttagttaattcaaccttatagatcatacttatgaaggtgataactgacacgtgttccctgaattttaatttgataggcaatacatctacccactccattattttttaaaacttcatttaatagtttaaacaagattggttttgttttcaatttttattcactcttcatagaatcacaattacctttatatatcatatgttattggaagagattcctcagtaatctccaatctctcatagtgcctcacagggttggtcaatggcttttggaactggaaggaccttagaacttatctgttatgctcctgatagccaatagcagatagaagcttgcaatcaagagggtaggacatgtgttcttcaatggatatcaaaggaagaggttgcaaaccaaagccatttggcaagccctgtagcctgggccatttaagacaggggcggtctcagccaaattgcacccatttaactatcccaaagagccacagtgcctacaacccaggccctaagttgatgaagaaaaagtcaaggaaggaggtgatacaattggaaatattcccatcaaatggttaatcttatttagaaaatgggcatattagaaaaagtccttccaagatgattttggataataaaagttgtatttgtggaaattggtattatctctgttttatgcacttacatttatcccttacattttgtttttagtgaccctacatgacattaaatttaaagtaaaacattgtttaatgttaccttttggcttgagaatgtctttcagctccagaattattgttactcatattttaatcagtaagtcatttaagctatgacagagtaggaattgagaaattatttcatatgctacagtattgaaatgtggatgctgccttgttttataagaagatgatcaaggtttgtgtgcccattacctttcctctgcctgaaagacgtgtctcaagaaaaataaattctattttagatgcaggtactgcattttattctaagaattgatatcaattcaaaacatagaaaactgtaaaagataaatcaggagatggctgattcataatgggtaataaaataaatagcactttcgagctgaaaacgtcag

SEQ ID NO: 30276 - DNA, 3551 bp, Homo sapiens
tggcgtaagaggcggcggtggaggcgctacgctggcgtaagaggcggcggtggaggcgctacgctggcgtaagaggcggcggtggaggcgctacgctggcgtaagaggcggcggtggagacgtttcgctggcgtaagaggtggaggtggagacgttacgctggcgggcacgatacaactgcagctgcaataaactggtccttatacctgttgggttctaacccagaagtccagaaaaaagtggatcatgaattggatgacgtgtttgggaagtctgaccgtcccgctacagtagaagacctgaagaaacttcggtatctggaatgtgttattaaggagacccttcgcctttttccttctgttcctttatttgcccgtagtgttagtgaagattgtgaagtggcaggttacagagttctaaaaggcactgaagccgtcatcattccctatgcattgcacagagatccgagatacttccccaaccccgaggagttccagcctgagcggttcttccccgagaatgcacaagggcgccatccatatgcctacgtgcccttctctgctggccccaggaactgtatagtaatttgaaggtcaaaagtttgctgtgatggaagaaaagaccattctttcgtgcatcctgaggcacttttggatagaatccaaccagaaaagagaagagcttggtctagaaggacagttgattcttcgtccaagtaatggcatctggatcaagttgaagaggagaaatgcagatgaacgctaactatattattgggttgtgcctttatcatgagaaaggtctttattttaagagatccttgtcatttacaatttacagatcatgagttcaatatgcttgaatcccctagacctaatttttccttgatcccactgatcttgacatcaagtctaacaaagaaaaagttttgagttttgtattttcttttttcttttttctttattttttttttttgaaaccgtgtctcactctgtcgcccaggctggaggagtgcagtggtgtgatctcagctcactgcaacctccacctcccaggttcaagcaattcttctgcctcagcctcccaagtagctgggattacaggtgcctgccaccatgcctggctaatgtttttgtatttttagtagaaacagggtgtcaccatgttggccagactggtctcaaactcctgacctcaagtgatccacctgcctcagcctcccaaagtgctgggattatagtcgtgagccaccacgcctggccagagttttttatttttatcaccaccatagatgttacagttggctgtggtcacaaaagtagttaattgtgtcagcacccaaataaacatctaacaggtttctcaacagaggaatccacagtccaattccacttcaattgatagacccaaaaaatataatttaatcaaagttctagagtttttgtttgtttgtttgagatggagtcttgctctgtcgcccaggctggaacgcagtggtgacatctcggctcactgcaacctccacctcccaggttcaagtgattctcctgcctcagcctcctgagtagctgggactacaggcgcctgccaccacgcccagctaatttttgtatttttagtagagatggggtttcaccatgttggccaggatggtcttgatctcttgacctcgtgatctgcctgcctcggcctcccaaagtgctggcattacaggcatgagccaccatgcctggcccaaagttctagaattttttaaaggtattcatggtgactcaggaatacacacatacacacacacacacacacacacacacacacacacacacatacacacacacatataatttgaaagaggtgagtatgtactctgacttcagctctcagttttcagattttataacctggagcagattattttaagttgattagtaggttctgttacagtttttcttttgatcgtgcacttatagtcttcatttaattcctcatagaatcccagtcacctttatatatcatattattggaagagattcatcttcataatctccagttttttcacagtgcctcacagagttaatcatgccttttggagctagaaggactttagaacttatctagttatgctcctttatattataagtaagggaatagaatcaataagacagtttctgcccaaagtcatgttaccagttggtgacagagctggaaatacgtagagatctatacccttaaatctctccactcacatgctgatatactttctactacaatatgctatagctttatggaactcagggtgatgatcagacgtgtcattagaacatgagtcctctgcttctgattcaggcatacttttgggattcttccatctttaaaggaaaaaggaagccattcatctatatttagtaacccagtaatatctcacttagtttagggttagatctttagttaattcaaccttatagatcatacttatgaaggtgataactgacacgtgttccctgaattttaatttgataggcaatacatctacccactccattattttttaaaacttcatttaatagtttaaacaagattggttttgttttcaatttttattcactcttcatagaatcacaattacctttatatatcatatgttattggaagagattcctcagtaatctccaatctctcatagtgcctcacagggttggtcaatggcttttggaactggaaggaccttagaacttatctgttatgctcctgatagccaatagcagatagaagcttgcaatcaagagggtaggacatgtgttcttcaatggatatcaaaggaagaggttgcaaaccaaagccatttggcaagccctgtagcctgggccatttaagacaggggcggtctcagccaaattgcacccatttaactatcccaaagagccacagtgcctacaacccaggccctaagttgatgaagaaaaagtcaaggaaggaggtgatacaattggaaatattcccatcaaatggttaatcttatttagaaaatgggcatattagaaaaagtccttccaagatgattttggataataaaagttgtatttgtggaaattggtattatctctgttttatgcacttacatttatcccttacattttgtttttagtgaccctacatgacattaaatttaaagtaaaacattgtttaatgttaccttttggcttgagaatgtctttcagctccagaattattgttactcatattttaatcagtaagtcatttaagctatgacagagtaggaattgagaaattatttcatatgctacagtattgaaatgtggatgctgccttgttttataagaagatgatcaaggtttgtgtgcccattacctttcctctgcctgaaagacgtgtctcaagaaaaataaattctattttagatgcaggtactgcattttattctaagaattgatatcaattcaaaacatagaaaactgtaaaagataaatcaggagatggctgattcataatgggtaataaaataaatagcactttcgagctgaaaacgtcag

SEQ ID NO: 30277 - DNA, 3606 bp, Homo sapiens
tggcgtaagaggcggcggtggaggcgctacgctggcgtaagaggcggcggtggaggcgctacgctggcgtaagaggcggcggtggaggcgctacgctggcgtaagaggcggcggtggagacgtttcgctggcgtaagaggtggaggtggagacgttacgctggcgggcacgatacaactgcagctgcaataaactggtccttatacctgttgggttctaacccagaagtccagaaaaaagtggatcatgaattggatgacgtgtttgggaagtctgaccgtcccgctacagtagaagacctgaagaaacttcggtatctggaatgtgttattaaggagacccttcgcctttttccttctgttcctttatttgcccgtagtgttagtgaagattgtgaagtggcaggttacagagttctaaaaggcactgaagccgtcatcattccctatgcattgcacagagatccgagatacttccccaaccccgaggagttccagcctgagcggttcttccccgagaatgcacaagggcgccatccatatgcctacgtgcccttctctgctggccccaggaactgtatagtaatttgaaggtcaaaagtttgctgtgatggaagaaaagaccattctttcgtgcatcctgaggcacttttggatagaatccaaccagaaaagagaagagcttggtctagaaggacagttgattcttcgtccaagtaatggcatctggatcaagttgaagaggagaaatgcagatgaacgctaactatattattgggttgtgcctttatcatgagaaaggtctttattttaagagatccttgtcatttacaatttacagatcatgagttcaatatgcttgaatcccctagacctaatttttccttgatcccactgatcttgacatcaagtctaacaaagaaaaagttttgagttttgtattttcttttttcttttttctttattttttttttttgaaaccgtgtctcactctgtcgcccaggctggaggagtgcagtggtgtgatctcagctcactgcaacctccacctcccaggttcaagcaattcttctgcctcagcctcccaagtagctgggattacaggtgcctgccaccatgcctggctaatgtttttgtatttttagtagaaacagggtgtcaccatgttggccagactggtctcaaactcctgacctcaagtgatccacctgcctcagcctcccaaagtgctgggattatagtcgtgagccaccacgcctggccagagttttttatttttatcaccaccatagatgttacagttggctgtggtcacaaaagtagttaattgtgtcagcacccaaataaacatctaacaggtttctcaacagaggaatccacagtccaattccacttcaattgatagacccaaaaaatataatttaatcaaagttctagagtttttgtttgtttgtttgagatggagtcttgctctgtcgcccaggctggaacgcagtggtgacatctcggctcactgcaacctccacctcccaggttcaagtgattctcctgcctcagcctcctgagtagctgggactacaggcgcctgccaccacgcccagctaatttttgtatttttagtagagatggggtttcaccatgttggccaggatggtcttgatctcttgacctcgtgatctgcctgcctcggcctcccaaagtgctggcattacaggcatgagccaccatgcctggcccaaagttctagaattttttaaaggtattcatggtgactcaggaatacacacatacacacacacacacacacacacacacacacacacacacatacacacacacatataatttgaaagaggtgagtatgtactctgacttcagctctcaggttttaaaaattatattagtgggaccagttatgacaagaataatcattatagtacttttcagattttataacctggagcagattattttaagttgattagtaggttctgttacagtttttcttttgatcgtgcacttatagtcttcatttaattcctcatagaatcccagtcacctttatatatcatattattggaagagattcatcttcataatctccagttttttcacagtgcctcacagagttaatcatgccttttggagctagaaggactttagaacttatctagttatgctcctttatattataagtaagggaatagaatcaataagacagtttctgcccaaagtcatgttaccagttggtgacagagctggaaatacgtagagatctatacccttaaatctctccactcacatgctgatatactttctactacaatatgctatagctttatggaactcagggtgatgatcagacgtgtcattagaacatgagtcctctgcttctgattcaggcatacttttgggattcttccatctttaaaggaaaaaggaagccattcatctatatttagtaacccagtaatatctcacttagtttagggttagatctttagttaattcaaccttatagatcatacttatgaaggtgataactgacacgtgttccctgaattttaatttgataggcaatacatctacccactccattattttttaaaacttcatttaatagtttaaacaagattggttttgttttcaatttttattcactcttcatagaatcacaattacctttatatatcatatgttattggaagagattcctcagtaatctccaatctctcatagtgcctcacagggttggtcaatggcttttggaactggaaggaccttagaacttatctgttatgctcctgatagccaatagcagatagaagcttgcaatcaagagggtaggacatgtgttcttcaatggatatcaaaggaagaggttgcaaaccaaagccatttggcaagccctgtagcctgggccatttaagacaggggcggtctcagccaaattgcacccatttaactatcccaaagagccacagtgcctacaacccaggccctaagttgatgaagaaaaagtcaaggaaggaggtgatacaattggaaatattcccatcaaatggttaatcttatttagaaaatgggcatattagaaaaagtccttccaagatgattttggataataaaagttgtatttgtggaaattggtattatctctgttttatgcacttacatttatcccttacattttgtttttagtgaccctacatgacattaaatttaaagtaaaacattgtttaatgttaccttttggcttgagaatgtctttcagctccagaattattgttactcatattttaatcagtaagtcatttaagctatgacagagtaggaattgagaaattatttcatatgctacagtattgaaatgtggatgctgccttgttttataagaagatgatcaaggtttgtgtgcccattacctttcctctgcctgaaagacgtgtctcaagaaaaataaattctattttagatgcaggtactgcattttattctaagaattgatatcaattcaaaacatagaaaactgtaaaagataaatcaggagatggctgattcataatgggtaataaaataaatagcactttcgagctgaaaacgtcag

SEQ ID NO: 30278 - DNA, 3553 bp, Homo sapiens
tggcgtaagaggcggcggtggaggcgctacgctggcgtaagaggcggcggtggaggcgctacgctggcgtaagaggcggcggtggaggcgctacgctggcgtaagaggcggcggtggagacgtttcgctggcgtaagaggtggaggtggagacgttacgctggcgggcacgatacaactgcagctgcaataaactggtccttatacctgttgggttctaacccagaagtccagaaaaaagtggatcatgaattggatgacgtgtttgggaagtctgaccgtcccgctacagtagaagacctgaagaaacttcggtatctggaatgtgttattaaggagacccttcgcctttttccttctgttcctttatttgcccgtagtgttagtgaagattgtgaagtggcaggttacagagttctaaaaggcactgaagccgtcatcattccctatgcattgcacagagatccgagatacttccccaaccccgaggagttccagcctgagcggttcttccccgagaatgcacaagggcgccatccatatgcctacgtgcccttctctgctggccccaggaactgtatagtaatttgaaggtcaaaagtttgctgtgatggaagaaaagaccattctttcgtgcatcctgaggcacttttggatagaatccaaccagaaaagagaagagcttggtctagaaggacagttgattcttcgtccaagtaatggcatctggatcaagttgaagaggagaaatgcagatgaacgctaactatattattgggttgtgcctttatcatgagaaaggtctttattttaagagatccttgtcatttacaatttacagatcatgagttcaatatgcttgaatcccctagacctaatttttccttgatcccactgatcttgacatcaagtctaacaaagaaaaagttttgagttttgtattttcttttttcttttttctttattttttttttttgaaaccgtgtctcactctgtcgcccaggctggaggagtgcagtggtgtgatctcagctcactgcaacctccacctcccaggttcaagcaattcttctgcctcagcctcccaagtagctgggattacaggtgcctgccaccatgcctggctaatgtttttgtatttttagtagaaacagggtgtcaccatgttggccagactggtctcaaactcctgacctcaagtgatccacctgcctcagcctcccaaagtgctgggattatagtcgtgagccaccacgcctggccagagttttttatttttatcaccaccatagatgttacagttggctgtggtcacaaaagtagttaattgtgtcagcacccaaataaacatctaacaggtttctcaacagaggaatccacagtccaattccacttcaattgatagacccaaaaaatataatttaatcaaagttctagagtttttgtttgtttgtttgagatggagtcttgctctgtcgcccaggctggaacgcagtggtgacatctcggctcactgcaacctccacctcccaggttcaagtgattctcctgcctcagcctcctgagtagctgggactacaggcgcctgccaccacgcccagctaatttttgtatttttagtagagatggggtttcaccatgttggccaggatggtcttgatctcttgacctcgtgatctgcctgcctcggcctcccaaagtgctggcattacaggcatgagccaccatgcctggcccaaagttctagaattttttaaaggtattcatggtgactcaggaatacacacatacacacacacacacacacacacacacacacacacacacatacacacacacatataatttgaaagaggtgagtatgtactctgacttcagctctcaggttttaaaaattatattagtgggaccagttatgacaagaataatcattatagtacttttcagattttataacctggagcagattattttaagttgattagtaggttctgttacagtttttcttttgatcgtgcacttatagtcttcatttaattcctcatagaatcccagtcacctttatatatcatattattggaagagattcatcttcataatctccagttttttcacagtgcctcacagagttaatcatgccttttggagctagaaggactttagaacttatctagttatgctcctttatattataagtaagggaatagaatcaataagacagtttctgcccaaagtcatgttaccagttggtgacagagctggaaatacgtagagatctatacccttaaatctctccactcacatgctgatatactttctactacaatatgctatagctttatggaactcagggtgatgatcagacgtgtcattagaacatgagtcctctgcttctgattcaggcatacttttgggattcttccatctttaaaggaaaaaggaagccattcatctatatttagtaacccagtaatatctcacttagtttagggttagatctttagttaattcaaccttatagatcatacttatgaaggtgataactgacacgtgttccctgaattttaatttgataggcaatacatctacccactccattattttttaaaacttcatttaatagtttaaacaagattggttttgttttcaatttttattcactcttcatagaatcacaattacctttatatatcatatgttattggaagagattcctcagtaatctccaatctctcatagtgcctcacagggttggtcaatggcttttggaactggaaggaccttagaacttatctgttatgctcctgatagccaatagcagatagaagcttgcaatcaagagggtaggacatgtgttcttcaatggatatcaaaggaagaggttgcaaaccaaagccatttggcaagccctgtagcctgggccatttaagacaggggcggtctcagccaaattgcacccatttaactatcccaaagagccacagtgcctacaacccaggccctaagttgatgaagaaaaagtcaaggaaggaggtgatacaattggaaatattcccatcaaatggttaatcttatttagaaaatgggcatattagaaaaagtccttccaagatgattttggataataaaagttgtatttgtggaaattggtattatctctgttttatgcacttacatttatcccttacattttgtttttagtgaccctacatgacattaaatttaaaaattattgttactcatattttaatcagtaagtcatttaagctatgacagagtaggaattgagaaattatttcatatgctacagtattgaaatgtggatgctgccttgttttataagaagatgatcaaggtttgtgtgcccattacctttcctctgcctgaaagacgtgtctcaagaaaaataaattctattttagatgcaggtactgcattttattctaagaattgatatcaattcaaaacatagaaaactgtaaaagataaatcaggagatggctgattcataatgggtaataaaataaatagcactttcgagctgaaaacgtcag

SEQ ID NO: 30279 - DNA, 329 bp, Homo sapiens
  misc_feature (2)..(2): n is a, c, g, or t
  misc_feature (17)..(18): n is a, c, g, or t
cnctctctctctctctnntctctctctctctctctatttcttgtaaccatttgttaaactcttttctttttctgatctcatggcatgcttttatgtattttgtacaggaggcaaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagttaaaaaaaaaat

SEQ ID NO: 30280 - DNA, 2101 bp, Homo sapiens
gggcgggacctggagctgagggcgggagccagtggacgcggctcagggtgggttcccgagggtgagacttatgggtgggccgagctgggggccgccctggcctggctcttcagacggcggggcaggtcgggcggggccgagccgcgaggcgttgggcggggtgtgatcctcgtcttgggggcagactccgggacggggcttagagcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagtgccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagttaaaaaaaaaat

SEQ ID NO: 30281 - DNA, 2086 bp, Homo sapiens
gcggccgcagaaccggcgggaggcgcggcggccgggcgagccgagggcgcagccagccgggcggaccgcggacagcggtcggggcgccgcgccatggggcgagccgggggcgggggcccgggccgggggccgccgccactgctgctgtttctgggggccgcgctggtcctggcctctggggccgtgccggcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagtgccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagttaaaaaaaaaat

SEQ ID NO: 30282 - DNA, 1162 bp, Homo sapiens
  misc_feature (186)..(186): n is a, c, g, or t
cgtacaaggccgccttcctgcttctgcctttgccctttgcaggctgtccttaacctagtcactaaaacgagttgtttagaataaaagtcagctcatggtcctcctctgctcaaaacctttttaaccttgcaacccactctttacagtggcttccaagatcctgccacggggccttgtacgcgtacnaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagttaaaaaaaaaat

SEQ ID NO: 30283 - DNA, 697 bp, Homo sapiens
agatttaaattttattgattaccgtatttccattcctagaatttatagaaatggcataccctgtaagtctaaatggtatgccacactacttattgtggatacaagatattttattgaaggtattattttaaaggagctaaatttaccctctaatgcaaaaatttgaaaaccctcattgcaaaaatttggtgtcttatagctctgtaataatgaatgggtttcgacttgcttatatagcttaaaatacatttctggttatcaaaaattgaggccaagcgtggtggctcatgcttgtaatcccagcactttgggaggctgaagctagtggatcgcttgatctcaggagtttaagaccagcctaacaatcatggtgaaacctcatctctaccaaaaatataaaaaattagccgaacatggtggcatgtgcctgtggtcccagctagttgggatgctgaggtgggaggattgctcgagcctgggaggtggaggttgcagtgaggcaaggtcatgccactggactccagcctgggcaacagagccagacctggtctcaaaaaaaatgactaacatggccgggcatggtggctcacgcctgtaatcccagcactttgggaggccgaagtgggcggatcacaaggtcaggagatcgagaccatcctggctaacacagtgaaaccccatctctactaaaaataca

SEQ ID NO: 30284 - DNA, 3635 bp, Homo sapiens
aatgaatccctgcggttggctgggggcagtgggtcccacactgcctaacttccctaaatgggcagcttcacttttagaaccccgggtccttccctggcaggcccaggtggcacatcctgtgtcgggtgggccctcaccttggatctccaggcctgacactgcccagctggatggaaccatggccccagccttcctgctgctgctgctgctgtggccacagggttgcgtctcaggcccctctgctgacagtgtatacacaaaagtgaggctccttgaaggggagactctgtctgtgcagtgctcctataagggctacaaaaaccgcgtggagggcaaggtttggtgcaaaatcaggaagaagaagtgtgagcctggctttgcccgagtctgggtgaaagggccccgctacttgctgcaggacgatgcccaggccaaggtggtcaacatcaccatggtggccctcaagctccaggactcaggccgatactggtgcatgcgcaacacctctgggatcctgtaccccttgatgggcttccagctggatgtgtctccagctccccaaactgagaggaacattcctttcacacatctggacaacatcctcaagggtggaactgtcacaactggccaagcccctacctcaggccctgatgccccttttaccactggtgtgatggtgttcaccccaggactcatcaccttgcctaggctcttagcctccaccagacctgcctccaagacaggctacagcttcactgctaccagcaccaccagccagggacccaggaggaccatggggtcccagacagtgaccgcgtctcccagcaatgccagggactcctctgctggcccagaatccatctccactaagtctggggacctcagcaccagatcgcccaccacagggctctgcctcaccagcagatctctcctcaacagactaccctccatgccctccatcaggcaccaggatgtttactccactgtgcttggggtggtgctgaccctcctggtgctgatgctgatcatggtctatgggttttggaagaagagacacatggcaagctacagcatgtgcagcgatccttctacacgtgacccacctggaagaccagagccctatgtggaagtctacttgatctgaggccacttaagcatggggtggggagcttctcccagagtggccccagggggttagaggaggggtgaagattggggccagtatcgatcttatgaagctggaggacttgtgcagtgctggactcacccaggacttcccaaacccagaggctgccatcctaagcagccccacagcccagtgttctccttgggggcaggaacctggggaggggcccagagcaaagggcatcagggagaaagtcccgaggaaatgtgaccagtggcttctgctcggagctgcagaccccagggctcttggtggaggcaggggaaccctgagagtgctgtttacagagaacctcagctcccgtctgcctcagaaaccctactgggctgagctgccctccccaccagggccactgtgtcctctgcttccctccgttctgcttcagcttcccctaaggttagggaagaaagaatcgggctcacgaatgccagaggcagtgatgtcccatcctggaggagaggaaacagtgactaaaagctggggacccacagaggggttggcagcttctcttgtcgggacaggtgtcctttgctgggcctctggatggccctgccctgactggggctgctcctccctcctgtcctgggaccccgcagagcccacgctctcactgctgcctcctgctggccgctgcctccttagaaagctgtgaccaggcagctaagagcctctgggctgcagggtcagcctctcccaagactgaagtgcagaggctggacttggggctctctcccccagcttctacacctgggctccaagtctgagttcccacaggggacccagcagcctccaggaagtccataccctggggtggctgagaccttggctctgtatggaggctgctcaccccacagacactggtggggagaccatggctcagaggaagggtggagcaaccctactcctacccctcaggatagagagagaagacacacttgggacacagtgaagacagtaacttggaactgaccacggcctggaggactggcccaggcagggggacagggaaaatggagcccaagtagcctctggccagggacccaatgtcccgaggaatctgcctcccacccactgactcagggctcagactcagcctctattgtccagagcactggcttggcgtccagcaatgaaggctggagaatgcagcctggattcccctacacacacacacacacacacacacacacacacacacacacacacacacacacaggtgtctactgacctggagtgactggaatagcacctggggataaatgtgacaactgtgcattgaaccctgggtcagggacgttccaatggccaagagagtgacacagccaggaccctggtggacagccagaggggccacttcaggatggatgtggggagagtggaagaggcagggagtaatcctgggggacagcagggaggaggcacttcttccctatgtccaggagagggcaatagagggaagactgaggctgaagaattgacggctctggacccaggacagacagacagacagacagacagacacgcacacacacccatctctgtctagcaagcagcctcctaagatagctgttctccctatcatgacggtgtagccaccatcctgttgtatactaggagagaacttaacccacctgggggaaaatagctccccaagagctggcaccagtaccactgatggccctgcttcctctgagtgagatgcccaggaggaggagccctagggaagaagtcagggacagggaccaggataccactctgtcactgtgtgaccctcagcaagtcactaacccttggcctcatttttcctgtcttgtgaaagaggacaataattcctacttctcaagattgttttcaagataaaataacattagcattgtacaatgatgcaaatgcctcattaccattattccttaagttgttttccagctctaatgttgtttccaacattacatttaagaccttaggattctgtttcttgcttttgtcatatctcttcccaagtgtcatcactatatggatgttgagggcccccgatgacagtccctttggtaaggtcctcttttgaggaggggagggtacagggtggactcatctcagtgtgaacttggcaagtcactgtccctctctgatcttgtttcctcatctggagaaggagtgagagaggagaaaggaagaaaccagtcaggcaggcagttagggtgggttctcggtagaattcttttaaacaaaagaacagcctgaaaaatcaagctgcaggcacagatatgggaacttgcacaggggggcttgcctaagacatgcccacagcctcatagataagacagactacacaggtgacttgcccaaacatgcctgcaatggaaaatttcatcccctgacatgtgcagtaaggggaacaaagcaatatggagtaagtaactcaagccaagggcccacatgtacattagaa

SEQ ID NO: 30285 - DNA, 884 bp, Homo sapiens
tggcctctctcagcgtgagacctggactgagcctgctaacgattctgttcctcagtttccccaaatagaaaattctaagattggtcagatgatcaaattatctatgttttcgatcttgatgctatagagaacagccatgttcccctgataacaagaaaaagacgtcccacggtcgaggtatccttgaccaactccccatccattcatttgttcaccgtccacaacccatctgatcaggaagcatttccaggcacctgcggagcacttagggcagtgtgcggaagctgcagggcaggcaggacgagggggcagtctggaggggggtggacacacagctgtccccagggagcccagcgcggtgccggtcacatgccgtgggagtggagggtcttgagcagacgcctcccttggagaagagccaccatctcaccttcccacgcaacaaattatctattaccagcacccgatgaggccgtccctcccaaattccacagtgcccaccactcgcactaccccccccgtgccacagaagcagtgtcagcagcctcgccacggttttcacgtcatgcagaaatggtcattccatgttctatggccaccagattctgctgagagtgtcgggatccttgactgcccagccacaccttgtgtgtgtctggtgtagtgtgtagtttacgaaacaaacggaaaagctcaaagacagcgatccaagacatgatcagcaatttggtcccaaattaggagaggaggaagaggagtatcaattttgtcaccaaaatgttaaaaaaaatgtccttggcgctctttttagctttcccgtttactaccagtccagacatgcaaaaaaaccttgtttattgaaaaataaacaacaagggctaaac

SEQ ID NO: 30286 - DNA, 875 bp, Homo sapiens
  misc_feature (857)..(857): n is a, c, g, or t
tggcctctctcagcgtgagacctggactgagcctgctaacgattctgttcctcagtttccccaaatagaaaattctaagattggtcagatgatcaaattatctatgttttcgatcttgatgctatagagaacagccatgttcccctgataacaagaaaaagacgtcccacggtcgaggtatccttgaccaactccccatccattcatttgttcaccgtccacaacccatctgatcaggaagcatttccaggcacctgcggagcacttagggcagtgtgcggaagctgcagggcaggcaggacgagggggcagtctggaggggggtggacacacagctgtccccagggagcccagcgcggtgccggtcacatgccgtgggagtggagggtcttgagcagacgcctcccttggagaagagccaccatctcaccttcccacgcaacaaattatctattaccagcacccgatgaggccgtccctcccaaattccacagtgcccaccactcgcactaccccccccgtgccacagaagcagtgtcagcagcctcgccacggttttcacgtcatgcagaaatggtcattccatgttctatggccaccagattctgctgagagtgtcgggatccttgactgcccagccacaccttgtgtgtgtctgcggatcggtgctccccaaccaacgggaagctcagaaagggatcacacgatcgcgtggtccccactgacagggcacaggaattcatgtgccaagttgaaaagcgggccatacatacgataaaacacagacaacgtcgtccacaggggcacagggggggccaggtagtgagatggagcacgctcgaccacgacatgattantgaaccgcgcgactcacc

SEQ ID NO: 30287 - DNA, 386 bp, Homo sapiens
  misc_feature (45)..(47): n is a, c, g, or t
tgagatggagtcttactctgtcgcctaggctggagtgcagtggcnnntcttgggtgacagagtaagactctgtctcggaaaaaaaaaaaatgggcaaaggatttaataaacatttcttcaaagaagatatgcaaatagccaacaaatacatggaaagatgctcagtatccttacctgtcagggaaatgcaaatccaaaccacaatgagataccacttcacatccactaggatggctagaatcaaaataatacatgctggtgaggatgcagaaaaattagaaccttcctacattgctagtggcaacgtaaaatgctgcagcagctgtgaaaaacagcctggcagttcttccaaaggctaaacactgagttgccatacatcccagcaa

SEQ ID NO: 30288 - DNA, 440 bp, Homo sapiens
tacagagtaaacattcttttttttaagtgcacatagaacttcacttagattaaccatatgctgggtgatatttttaaagtctcaataatttaaaagttttgaaatcacagaatgtattccctgactgaaaacagagttaaattagaattcactataatagatatctggaaaattcccagatatttagaaattaaacaatagtcttctaaataactcatgggtaaaatacgaaattttatggaaaattagaaaatattgtgaatgaagatgaaaaaacaacatgtcaatttgtaggatgcaggtaaagcaatactagaggaaaattaattgctttacaataatgatctaagcttctacctgaataaacgagaaaagaagagcaaattaaacctaatgtaaaggaaggcagtaatatagagcagaatcagtgaaataaaaga

SEQ ID NO: 30289 - DNA, 368 bp, Homo sapiens
atatcttgctgacatacctgtagggtaaattcctgtgagtgggattgctacatcagtgggaaaatacatttcaaattttgataaacatcaccaaattcttctctggaaaggtcactgattgtttgttttttcgagacagggtctcgctcttcacccagactgcaatgcagtggcacaatcatagcttattgcaacctcaaactcgtgggctcaagcaatgctcgctcctcccaagtagctaggaccacaggcatgcaccacgatgcccacctagttttttgtattttctatagagatgggggtctcactgtgtttctcaagctggtcacatactcttggcctcaggcagttctcccacatcagactct

SEQ ID NO: 30290 - DNA, 568 bp, Homo sapiens
gtgagccaatcactgtgccatgtcacatggattatactaccaccttctgagttaggttttattaatgcagtttttacagatgaggctactgtgacacagagggcataaacttgtcaaagacatgcagcaaacaggacagacaaatctgaagccaggttgtctaagctcagaatccacacctataaccgctgtaccccactgcttttgccagcaggagctcacgtacttaggacagacaatcagtacagtgctaggctcactgaaggtgttgaacaaatgtctgttcactctttttgttctcaaaagtaccaggaaaggccagaagaaaaaactacaagacttagaaactacaatggatcagatcactcagtagcacctcactagaaaatattaccagtcttataagtgcaaagtttatgttgtaattgtagcaatcatgattccagctctcttcctgacacatggtaagactgcactttatgcctcccttgcttgtattgggcaacatgactaattactactcagtgacttgagtagcggataacaggggtactcaagaacagctcga

SEQ ID NO: 30291 - DNA, 799 bp, Homo sapiens
gtgagccaatcactgtgccatgtcacatggattatactaccaccttctgagttaggttttattaatgcagtttttacagatgaggctactgtgacacagagggcataaacttgtcaaagacatgcagcaaacaggacagacaaatctgaagccaggttgtctaagctcagaatccacacctataaccgctgtaccccactgcttttgccagcaggagctcacgtacttaggacagacaatcagtacagtgctaggctcactgaaggtgttgaacaaatgtctgttcactctttttgttctcaaaagtaccaggaaaggccagaagaaaaaactacaagacttagaaactacaatggatcagatcactcagtagcacctcactagaaaatattaccagtcttataagtgcaaagtttatgttgtaattgtagcaatcatgattccagctctcttcctgacacatggtaagactgcactttatgcctcccttgcttgtattgggcaacatgactaattctggaaaatgagttgagcagaaattaacatgtttcctggaattttaaactgatggtttaagaccctgcaaaactccctccctctgcaacagcaaccagtctacaatggtcagacttcctacaatgaccaacttgaaatgaacacatagcatgacagagaaataaatctcattgattaagtcaatgagatgtattccacatcagaacctggcccaccctaatcaataacgtaaaccaattatctcctatgagctgctaacacattctctatcacatattaatac

SEQ ID NO: 30292 - DNA, 171 bp, Homo sapiens
cagtagtttggtaaaaactaccaaacaaaattttaaaaagcagccagtgagtggggaaaacaacaaaaacccgtattacatttaggagggcagggacaagtaagaatgacagccagccaagttttcttaagaaaatgtggttacaatatggttatctctgttagtgctgaa

SEQ ID NO: 30293 - DNA, 160 bp, Homo sapiens
ttttgagaaataaggggtttggaggctcaggacagaccatcccactgctgtcttagggacattgggctgctggagcctggcccaaagaaggtcttctgggaaatcaggactgagtctgggcaatgctagagtcagtgggtaaaatggctttggagtgtgg

SEQ ID NO: 30294 - DNA, 358 bp, Homo sapiens
gaaaattataagaattcaatctaaaaagcgtgaatggcttttcgtctccctagtactctgggatagaatgttgatgttttacaagtctgctctaattttcacaggagtggacaaacctacacacagagctgaacattacatattttcctgacttgttttctacaatttttatacttacccaaatccaacatgctttttcctaggaaaatgttctcaggttcttaaactgttcatttcagggaaaactcaatctacttgtatgggttcggtcttgtgtatcatcttacacagtaaccaaaaaaggcaaatttgattcatttaaattacagttaaatttatttctaaaagacaaatatat

SEQ ID NO: 30295 - DNA, 409 bp, Homo sapiens
tcaagaaatatcttgagggtttgtttacaatacagttaccaagtccaccttctagataggctgctttagtgtagtgttctggaacctttatttttaaacagattatccaggtaattatgttgtgtaaccaagagggaccactggtgtagaaacaatcagagagacctggggctgaattttactcagctcttcccttactgactctgacattgggcacatttcttaacttttatgaggataccgtgatataactggtacggttgtaatgaggcttagcaattatgtatgtataggaaacagtaactgctatggatgacaacgatgatagctcattaagctcatttggaatctagatgcagtatcactaccatattcatcatcatcatcatcgttggtcgacgcggccgca

SEQ ID NO: 30296 - DNA, 353 bp, Homo sapiens
gctactgtaaaaagtatttttgataagtacctgaaatttataatagtagagttcatgtttagcactttgtccccctttgcaactacctatgggaggcagaataggaaagtgtttaagagttctggttctggaataagaaagagcttgggccaggtcccagctcctctactttttagctttgtgaacttgaacaagtaatttaacttccttgggtctctattacctcatctgtcaaacaggtatagtagaaactacttcaaaggaatgtgagttatatgagatgatatatgtaaccatttggtaaatatttgctgtcattattataaatgaggaaactgatgctaaatagtgag

SEQ ID NO: 30297 - DNA, 669 bp, Homo sapiens
ccttaggggaggatgtagttgggggttcatgcatcaggtgggcaattggaagagatacgtcctctaaagtcttattgattctaagattttctgggtctggagctcattgacaagcgtaaggctagttggagcttttatagtctttattgatagcagtcatcccccacacacccctgatagtaatacactttactatctgtagtcatgaatgagaaagaatttgttttaaagcaacaagggggagaattgtgatattttaaaagcactaacatttttcttttttatctcaaagtcacatacttgtcatttgtgaagctgaataccagaagaatgcatgtgttgctgactagattgttgatattaaggagctattgtttgttactttatttttaggtgtgatgatggttttgtttttatgtttaaatgagccttgtcttttggagatacatactgaaatatttatagatgaaatgatctgatgtctggggaggtttgctttaaagtaatagaggagtggggagtagacaggggtatagatgaatcaaggttggccatgagttggtaattgttgaaactggtgataggtacatgtgggtttatatactattctgctttcatttatgttttgaattctccaaataaaacttaaaaaagaagtagaaaaaaagt

SEQ ID NO: 30298 - DNA, 1024 bp, Homo sapiens
atgaggccttggtagatttagaagttgagagtagaaagtacaggtttgtattttagaaggagatttgggaataaatgtagctttggttgatatagatcatatgttaaggtttgttggccagagctggtgtgtgtcttgggtgttgggcaaagaacagagaacagccaaagctctgcgaggtcaatgtgaaggatgatttccttggtgggctcaagtttatgactcagcctggacctagcttggcttctcagcttgagaagaagcatgattccatgtcacagctcctgtctttgaaaaagtcataatgactcccagacccaacatgtggagaaaactctggatttgtctcttcagttgaatgtctccattgaaaattgaggaaagaaatctctctaatatttgaacttcatcaaaagactaatatgttaatatttgaccgtcaatatttccttaaactagtctactgcttacatagctaacacatcaaagcatattaacttaggaaatgggattctcccaaacaatgaaacattgacggcaagcgttcttcatcttttcacatcacatttccttcaaatgctttatacatcttcaagcagacaaataatagtattataatgattacgagaccgatcattactcttttgccaaaaaaaaccaacgacaaaagactaacttagtggaccaacctttgtttcttcattatctctaccgtggttctgtccttttatttcgtctttcttctaattctgcttctgcttcttatttcctccctggatttgaactttacttacctaaactaccagttaggttaccttctcagaacctctaaggcagcagtttgaggttgatgatggaagatttaggattagaaaaaagaaacatgaatgaatttctgatgttttattataggggtttgtaatgcaggtagaaagacctttttcagagttaagagtttgatccgacaaatgagctattttgatatttataacgttgtctaataaaagtttcctataaaaacaaa

SEQ ID NO: 30299 - DNA, 1329 bp, Homo sapiens
tcagcatgccccagtagtctcaggaccaccataatggagaatccttgtaaatggtgcaataaagcttcattcagaagtttgataattacagctatcattcaggagacaggccttagaaagagtaagagttcatgaatttaccagactaatggtggacatgtccaaattgatgtccactagaatgtaaactacatgtgtctttgctgctaagtcgtcacagccttaacattgattagcactttgtatgtgttcagtacttgtttgttaaatcaatgaaaggataaaacatatgtatggatttggatacaattttgtgtatccaaaaagggaagcctgcaaaaaataattctgggaaacatgagttgaaatgcagagtaaactcagtactgcaatccatagcaatattttgcatattattattttttcttttaaatttttttcttgatcagatttatcatattcattgaatattattttattgcacttggctcctggcttccccccatcctgtgctctgaagtcagagtattatttgtggctctatgaaatgtccattgcttgtatacggtataaatttaattatcttttgtagtttttctcacagtatagactgaaaaggtttggttaattttgcaataacagaccactgcatatttcacaattaagtgttttcaacagtattaaggcaagatttacagtaacacttttaaagtgccagatgtacattgacagaaattttcttagtcaatcctagattgatcatgatttgtgatttctatgcaggccttggtatgattgccttttaattgctgtacaatttcttttttttttttaacttctctggtataaaatattctaaatttgaatgacagcttttgtcaaccttcttatccaatattcttccaccaacgctatgaaacaggaagagaaaatggagtttggtaatttcatcaaatatattcattattgggggcaggagtaacatttaaatcctcctctttattgctggccgtaaaaatatgtcttttggagagcagaacatgccagaatgtataaggtgcaactgtttgatatgaaaaccataggataggaaactatgcctatgacactaaaactccaaaaagtagaagaccacattgatgatgtcactgcattttaaaatggaaagaacaagtgttcaagaacaggaatttgtgtgaattgcatttattcctataataatatgaactcaatgagatgatgacatagacacaataacaaaaggagaaaaacaatgtggctttttttagccttcataacctaatcaaataaatatctttgtgtgtttta

SEQ ID NO: 30300 - DNA, 1395 bp, Homo sapiens
tcagcatgccccagtagtctcaggaccaccataatggagaatccttgtaaatggtgcaataaagcttcattcagaagtttgataattacagctatcattcaggagacaggccttagaaagagtaagagttcatgaatttaccagactaatggtggacatgtccaaattgatgtccactagaatgtaaactacatgtgtctttgctgctaagtcgtcacagccttaacattgattagcactttgtatgtgttcagtacttgtttgttaaatcaatgaaaggataaaacatatgtatggatttggatacaattttgtgtatccaaaaagggaagcctgcaaaaaataattctgggaaacatgagttgaaatgcagagtaaactcagtactgcaatccatagcaatattttgcatattattattttttcttttaaatttttttcttgatcagatttatcatattcattgaatattattttattgcacttggctcctggcttccccccatcctgtgctctgaagtcagagtattatttgtggctctatgaaatgtccattgcttgtatacggtataaatttaattatcttttgtagtttttctcacagtatagactgaaaaggtttggttaattttgcaataacagaccactgcatatttcacaattaagtgttttcaacagtattaaggcaagatttacagtaacacttttaaagtgccagatgtacattgacagaaattttcttagtcaatcctagattgatcatgatttgtgatttctatgcaggccttggtatgattgccttttaattgctgtacaatttcttttttttttttaacttctctggtataaaatattctaaatttgaatgacagcttttgtcaaccttcttatccaatattcttccaccaacgctatgaaacaggaagagaaaatggagtttggtaatttcatcaaatatattcattattgggggcaggagtaacatttaaatcctcctctttattgctggccgtaaaaatatgtcttttggagagcagaacatgccagaatgtataaggtgcaactgtttgatatgaaaaccataggataggaaactatgcctatgacactaaaactccaaaaagtagaagaccacattgatgatgtcactgcattttaaaatggaaagaacaagtgttcaagaacaggaatttgtgtgaattgcatttattcctataataatatgaactcaatgagatgatgacatagacacaataacaaaaggagaaaaacaatgtggctttttttagccttcataacctaatcaaataaatatctttgtgtgttttatgttcttttgagtgtttacatactgtgtaaatgaatatttttactgatctttgctggcaatgagtg

SEQ ID NO: 30301 - DNA, 1339 bp, Homo sapiens
gggagacaccgctcttggggaagttgggctgcagcccccgcacgtgctaggaagataagtgaaggtcccaacacatcctgtccccttagagcccctggggcccagcagccgggcccagcagcccgacccagcgcctagagcccattcgcagacagcgcgctgaggcggcttgggcgccatgccctttgggttactcagctcttcagcctcctggaacgctaggacaaaggagtgccttggtgctggcagaagccggggggcacagctgggttttacaaggaaggacgaaatctcatctcagcaatcgggatagatcaaccgttgcccgtctgaggtgacccaattcagggaccagccgcttggctctgaacacacacgtgtcacaaccccagctcgtacccaggccttgctagagctccaggtttatgagccgtaactcagcagaagcctagcatgagaacaactcatctgaagctccaacatttggggaatgcaacctttcgacagacatttgctgaatggataggagactcctgaaagcagaattctgcacattctgtggaccagccctgactacggagagcaggtgttagccagtatccatgcgcagtgcctcttagtcttacctgtctgctgccttacgcaagcatggagcttaatatgctagctgtgttctcctaacctcagatatctgtaaaaccagccacagtaagataacatggtagagcacaaaatgcttagaagagatttatttgaagcaatgcttcccagaagtttttcaatgcagcttatggcgagaaacacattttacatctctactcagtacgcagccactcatactcaactgaaacatcttctgaaacaatatttcacttcactctctgcaatacagaaaataccagatcgtattgtatgttatttcattgttttaaaatcctgagcctagcttgctaatagattacaactcagtttgaaaagcacaggctaaggggcttcaaataggggtgacacattgaacacacacatttatcacctctcccttcacagatctcattaaaatgataataaaggaacaaaatggcagaaatccacaaggacaaacagcaaacaagagggacatcagcagataggcaacctcaacaagtatatcacaatgagtgacacaccccctataacagccaattttgatggtcctcccatagctcttgccttattctttgtaataggattcagattgtttaaaatccccatattctaccgcaaagtcatgttatcaggaaagaccaaccctaaccccagttccatggagtaaagattaattaatctaaactctattaat

SEQ ID NO: 30302 - DNA, 2637 bp, Homo sapiens
  misc_feature (1304)..(1304): n is a, c, g, or t
  misc_feature (1540)..(1540): n is a, c, g, or t
  misc_feature (1718)..(1719): n is a, c, g, or t
  misc_feature (1721)..(1721): n is a, c, g, or t
  misc_feature (2631)..(2631): n is a, c, g, or t
  misc_feature (2633)..(2633): n is a, c, g, or t
gagacggagtctcgctctgtcaccaggctggagtgcagtggcgcgatcttggctcactgcaagttccgcctcccgggttcacgccattctcctgcctcagcctcccgagtagctgggactacaggcgcccgccaccatgcccgactaatttttttgtatttttagtagagacgaggtttcaccggattagcgaggatggtctcaatctcctgaccttgtgatccacccgcctcagcctcccaaagtgctgggattatgggcttgagccaccgcgcccagctagacttttttctaatagagtcccccataaattttattaccatagatacgctgtgtatgtactgtttctgtgctttgtacatgaaaagagtaaaatgtttttgtttttgttttggagacagtctcactctgttacctgggctggagtgcaatggcatgatctcagctcactgcaatctctgcctcctgggttcaagcgattctcttgcttcagcctcctgagtagctgggattacaggcggccaccaccacccctggctaatttttgtatttttagtagaggtttcaccacgttgatcaggctggtctcaaactcctgacctcgtggtctgcctgccttggcctcccaaagtgctgggattacaggcgtgagccaccatgcccaaccaattttttttttttaaatccttggtagtgattgacccccattgagaatgcatgctctaatattttttaaaagggaagaagacctagtgatagacctttgcattggcaggcatgtctttatgtttatacagtgaagtagtattttttctgtcagggtcaatagaaagtagacgaaattcattttcagccaatctttcaccagttgtgctttgttccttaccccaccacaggcaacagacaaagcatttcctgctgtctttcaaggtcttaacagattctttcttgattataaatgtattactaagtagaatcatttgggttctttctataaaaatcagtgaaaatcctctagatgaatgaattaaagttgtaggcataacactgataaacctctgctctcatactgaagtaggctgcttgcaggaactgacaactattggttggctttaaatgtaatgtagatgccaaagttttagtgtacagtgttacttaaattaccaaattacctttgtacaaatattcctcagatgctgtctacaggtgccatataaaataggttgataagtatttgcaaattctggtaaattgccttgctatgatttttcatgctcagtattagtcctctagtatcaatacgnagtttttctattccccagcctactaaggcctacaggttaaaataccaggaataaaaaggttttcagtggacttgatttaagtggaatctggatgatgtgacaagtacctttgtctttggagtaatgagtttataattggcttttgtccaaaaactcttaagtggattaatatctgaacaatcttagacataattatatgaaactggatcagaaaggctttctgactcctttctctncacttttttctcccagcttaactagaggcaattaacagtcatttcaaatctaattatttttattttccagtgtacttatcatcctttcatctttatgctaggagtatagtctcagttcttaatgagttgatgggatgaagatatagatagatagatagatagatagatagatagatanntntttttttttttttttttttttttgagacagagtctcgctctgtcgcccaggcgggagtgcagtggcacaatctcggctcactgcaagctccgccttgggggttcacaccattctcctgtctcagcctcctagctgggattacaggcgcccaccaaccaagcccggctaaggtatttttaaatgtactcaatcactgtcattttagtaaccttgaatcagaacctcagttgttaaaggcttaactgcttgtggcaactactatagtgctctagtggggacagtggttaaaatctgcagaatcccttgctttgtcatcttatccagaaggactgatagcttgttaaactgtggtatgattagaatgttggtggttgtgtagtgcatttggggtgctacaacgttaatcaaatataattgagctgttctgtttccagtcagtgtaaccatttaaaaataccttggcaaaacaagctaggagctagttcatgctaatattcttaaggacaaaaatagtttacagcttttttttttttaatctgaaatcctgaaggctatgcttaaaagttagagataaacctgttggaaataagtgattcatttatagactgaagcctctatgacttcaaaaagatactcaacagtctctggcatttgaagaacaaaatattttctctgtaaatacacctcatttccattctagttaggagcaatggcgcccaggacggcacacagaatggagaaaactggatagctggtaactcatttagctcttggcactctaaaaaacctcaaatacagccatccaagccagtaattctattgctgcgttatttctgtgtttaactgtgaaacttgcttcttgtctgtacccttgaaatggaataaaatttcatgagactccttgttaaananaaaa

SEQ ID NO: 30303 - DNA, 1204 bp, Homo sapiens
actgagtgactgggcgagacgaaggggcctgtggggaagggtgagggtgcaggtcaaggacagcagtaggagcttactgcagtgactgtatcataactgctggttatgaggattggatttcttttttgcagatgtcacgtgccggggtgaactgttattaactaaaaggagtcagggcttagctgcaaggaaaggaggaattgctcttaaagtgcttggaagtcaccgatctaaccaacggacaaaaaatttcctgaggacagaccctcccctctggaggcatccttctatcattggctcctgactccccgaagcaaggtcaagtgggagtttaatagctgttcctgggactgtgcagagggcagccctttgaactcagtgtctcaatcccacaggtgggaggttcccaccactgcgtaatttcgagagggagggccgagactgcctggggggaagtcccatggctacctggttcgaggcagctctttgatatctcctggagcactcctggtcctagaaccagacagctctcaactgaactgacacaagtaacaaactcagcatcccctctcctgggcattcctacaagccatgcgagccccgtgttggtggagacactgccttctccaccgcagacaccaacaagttagaatggagaaactgtctatggccctaccactctgaacacgccggatgtcatctcatctcggaagctaagcagggtcgggcctgcttaggacttgggtgggagaatggagaaattgatggacttttgacgatgcaggttttaacatcagatctgagccctaatagctgtgtgtctcagctgtctgggccacaccattaacagggaaaagtttcctccacttaaagaaagaaaaagacaaagaggagaaggaaggcaatacggagctctcctggaaggtacattaaatcattaaatgccagcctgcctgtttcacgtaggaggactcgtatatgtgttcctggtagggaatgtgtgtccaaaacaccagcatcttcttctcagcccacccaggctgcccccatcttgtttaatgccgtttaggcagaataactatttctccaattttccagtgcagaattagactctttaacttgacttctgcattttcctatgtgagactcagccggatgtatgtcctctcccacgtgtacaacccccataaactgaactaagaga

SEQ ID NO: 30304 - DNA, 232 bp, Homo sapiens
actgagtgactgggcgagacgaaggggcctgtggggaagggtgagggtgcaggtcaaggacagcagtaggagcttactgcagtgactgtatcataactgctggttatgaggattggatttcttttttgcagatgtcacgtgccggggtgaactgttattaactaaaaggagtcagggcttagctgcaaggaaaggaggtatgtggttgagtgcattgcaacacggtctctca

SEQ ID NO: 30305 - DNA, 264 bp, Homo sapiens
atccgccttattttatagaagaaaatactgaaactcaagacccgctacctgggcaggggaggagcagagaccagaaccctggacctctggctccatgctgtttctactctacactccatcttccacatctgctttttgctaatatcccatagctaagaaataagatataaacaatgccttgaaatacaagacaaccaaggcctcacctttctctcattactcaaatgatgcaaagcccgaagccctctccacctgacttcatcc

SEQ ID NO: 30306 - DNA, 420 bp, Homo sapiens
tagtggagtttactgtagaatagaaggtaaattcagttaaactcatttgtttttgtatgaactcttatcagcctcaaatgactagttctgtgggtcttgggaacaattgaaatgtagcccagtagtggaattctgctgagttgaagaagggtctttgctttactgagatatagcccaactactgtggaccacaaaccaggatccctgcttttaaagttagctatagggtttaactgtttatctagataccagatgtgtaggattctgcattttagaaagaagtagatttcttcctaaaagactgttgtcttgtatcagtgtctggctaatcatctagtactactaatttcatgaactttaaaatcttatttattccttaaatatgttaatttcgggttagggatgatatataggaatcgg

SEQ ID NO: 30307 - DNA, 496 bp, Homo sapiens
gacttactgtgtgctactcgagctttcatgttgctttacttacaatgtttgaatacatctacaatatacaatctttgctttggaaatttgtatatactttttatgctactcttcatattttaatacctgatttaatacccgatttataaaaacaatatataaatacccaatggttttacacttttggattaaaagcaaggaagctcagcctatatttattttcctttatcttctatacttttaagtatcaccttccctttagtatccaagtggagttataatttttgtttctatcatcaactatgatttataatactcactaggaaaacacatctattggatgtattcatatttctgctaattctattaatacatcttccttctttcttgatgttcaaaattccttttttttctttattttgtttgaataacagttttagtaaacatttaatgctaagcttgctaacaacaaatttttaaacagttcaaaaaaaaa

SEQ ID NO: 30308 - DNA, 411 bp, Homo sapiens
gccttacaaccatgtataaaatagtgaactgcgatatgatggagttgctcttatcttcatcccgggatgagaaaatagaggcagaagagttttaagcaatttgcacagttaataaagtgtggagccagaatttgaacccaatctggctccagacctctttactacagctctcagttagaaaattatttctaactgagatatttcggttcagcaagtgttggcttagttcctgtgtgctatgccagcagaaaatatagttcctacacagaagagcttacatttttgacataaatcaaaatgtatatacttgaaataaatgctacaacaccttagcatatggggtgtaaatgttgtgtatggatcagcatgaataatagagactgttagtgagtggcttgagagttaatttgc

SEQ ID NO: 30309 - DNA, 1242 bp, Homo sapiens
gaggctgaagatacatgacaccagatgaaaagtggatccacaagaacagggctccccaacccttgggccacagtgtgtggcctgttaggaactgggccacgcagcaggaggcgagcagccgtgagcattattgcctgagctccacctcctgtcagatcagtggcaacaatgatttctcataggagtattgcgaactgcactcgagggatctagatggcacactccatatgagaatataatgcctgatgaaaccatccttgctcccaccccccacctccatctgtggaaaaattgtcttctatgaaattggtcctggtaccaaaaagtttgggcaccgctgcacaagaaagattgaaaagtaccagaaagtaaatatgtaacaattaggtttcatcctccaaaagaagacttggtaagcttatagagcaatggaataatttataaataaataaataaatgtctcaaaaataagaaattaaaaaattaaatcagtatgtatgtagggggtggggcatggaggaaagatcattattcagtaactggtgttgaggtaactggctagccatttagaaaacaaattttgatctctacttattcataaactatcaaattaccagtagaaaacatgtgaagggattttaaaaatataatcttagagtgggcaaggctttctaaggctggtgtagaagtcaaaagtcagaaagatatgtgaatttgagcacgttaaaaacttttgaaatttctacattggaaaattgccatatagtcaaatacaatttatacgtacacacacacacacacacacacacacacacacacccatatgatagcaagcctctttattaaatagaactatgtcttacacatcagtaaggaaaagtgctgcagcaggatataaacatgtgcctagtgcacagaaagtgaaatgtaaatgacttgtagtgagacaatactaaaaatatctttgctatcaaagcaaatgttcctcgtggattcccaatctcacatgcaaatacatagccattaaagttaaatttgttttttttattctttattatcttctcaacataagcatgtgctgaagtttaatagcttgttattcttttgtaatacagaatacagcatttaacatagtattttttatttgtcttctttattgacagtttcacttgagtatagaatagctttaagcttctgtagtgaccaagttagtgatcagtagaaactctgctgggaattatc

SEQ ID NO: 30310 - DNA, 343 bp, Homo sapiens
gctgggattacaggtgtaagcccctgtgcccagccagcaatttcttctagaaagtcccagcagaggctgggtatggtgaatcacacctgtaatcctagcattttgggaggccgaggtgggtggatcccttgagcccaggagtttgagaacagcctggaacagcctgggcaacatagggagggacctcatctctatttaaaaagaaaaaaaagaggccgagtgcggtggctcacacctgtaatcctagcactttgggaggctgaggcgggtggatcacctgcgatcaggagtttgagcagcctggccaacatggtgaaaccctgtctctactaaaaatacaaaa

SEQ ID NO: 30311 - DNA, 521 bp, Homo sapiens
gtcagtgtcagggaaagcgcttgagcaggcttgctcgtttgcacaagggggaaaaaaaggaactggactgttcagaatgaacaaaggcggtggcggggcgggggcgggggaagactaatgtgtcttcagtgtataagaagggaaggagctgggagaaaacagtcagtggaataaggcctggggcaggatggggcgggggtccttcatgaatctgatggaaagactggcccctagcagtgaacagaaaaatactttatggagaaaaatgccttgaatttcctaagcctagtaaattttctatataagttatttttctttaggagaaactattattttcttgtaccaacttttaaagtaaatttcaaactgacataaaagttgaaacaatagtacaataaaacccatgtatcttcttccttaaattcaccaactgttaacatttgccatattttctctccctccctataaaaaaacttacatttttttgatgagtatcaaaagttgcagattaaaaaaaaaaa

SEQ ID NO: 30312 - DNA, 418 bp, Homo sapiens
agggtttaactgaggatggtgtttggagaacagaggatgaggaaaataagctgctttttgacttttgaaatgagaatattgctaggaagtggttgtttctggagcttctaataattagctccctcttccatgtgttttgatgttgggattagtggaaaaagagagaagtttttgtgtccattgttgtccactataaagcttggagtttcaggttgaactagattttttttttccttcaatcctctgaaagcttcccctcaggccccatctgctgccattggtcaccacagaaatacccccacagaattcctgtaaagaatggcactgcttctgaaggactgctctaagctgatgtctgaattcaattacatgtcatcagtgcatgctttattcataacatcatcttattgtaaacatc

SEQ ID NO: 30313 - DNA, 388 bp, Homo sapiens
  misc_feature (336)..(336): n is a, c, g, or t
  misc_feature (366)..(366): n is a, c, g, or t
tcccagcacttggggaggccaaggcaggcggatcacctgaggtcaggagttcaagaccagcctgaccaacatggtgaaaccctgtctctactaaaaatacaaaaattagtgggacgaggtgccagtagtcccagatacttgggaggctgaggcaggagaactgcttgaacccaagagatggaggctgcagtaagccaagatcgtgctgctgcacttcatcctgggcaatagagtgagtcaatttgtaagaaaacacattattatctgtgaagcacaatgaaaagtgaaataaaacaaggtatacctctactgaaagaaaaaaaaaaaaaaaaaaangttctttattttaaggcggccgcaagcttntttccctttagttgaggggtta

SEQ ID NO: 30314 - DNA, 444 bp, Homo sapiens
cctctctgttttatctttctgtaattagcattagtcagatgttagatattctggattgatcctgacatttcaacttttctttcctatgttccaactctgttattttaaaaaaaaaaaaaaaaaactcggaccacataagctagatctctggagggctagcctcagaagtcacccagtgtcacatgggccacattttattggttacagggccagccagtttgaaggggaagagaaatatgtctctgtttatgctgtgtccagtgctagcttgctacctgctctcccagttccagtgctcagggcagcactggcagaacagatgtacttactgagttaaaaacagcaacatccaagacaattgttaacttttaaaactgtctcccatcccagaaggtataactaaaaaactaacaataaaaataatagtaataaataataaaaata

SEQ ID NO: 30315 - DNA, 492 bp, Homo sapiens
ggcgcagctcacgcccctcggcctacgggagggagggcaaggagggttctacggttcctgggaggacgagaagagccaagagccccgacggccggcgccggggaaaaggccccgaggcggggtccgcatccctggaagggcggcgtccaccctcctgagaggcacggggcgcccagggctcggaggctcaaagcccgccggctcctgcagcttctgggagccgaagagtgtcagccgggaggatcccgcacacggcgcttagttctggaactgcatacccaggggaggatgcgggagcccgaagcccgggtatgtgtccccgaagcccgggtgtgggtccccatggttttcgtgttgggggtgggcgcggaacgctaagcctgggcctattgggagccatagtcttcttgatggctggtgcttattgggcttttttcagtcgaatttcgaaatgcagttgaatttcttactttggaaacgataatagaaatg

SEQ ID NO: 30316 - DNA, 452 bp, Homo sapiens
atactaaaaaccactaagctgtacatttaaaagggtgaatttgatggtatgtgaatcatgtctcaagctgatgacaactagaaaaggtccaacaagactgagagagaaagaggaggcaagtcccagataccagagcaggtggccccaacagagacgaggccacggaagagggaacagggcccggtcagacccctgcagccagatcctgggacagagaaacttgggagctgtggcaggagggaccacagacccaaggtgtctgcagacctgagggaggactgacgatgttcctgccagggctgaactcatcttaaaagaaaaaaaaaaaaaaaggccgggcacggtggctcacacctgtaatctcagcactttgggggactgaggtgggcaaatcacttgaggtcaggagtttgagtccagcctagccaacgtggtgaaaccccatctctact

SEQ ID NO: 30317 - DNA, 783 bp, Homo sapiens
  misc_feature (271)..(271): n is a, c, g, or t
  misc_feature (283)..(283): n is a, c, g, or t
tgtgattatgcatatttgcatctgaattaattttgacttataataataattaaaactttaagatttgtttttggtattattcaagtatgaaccattcactgaagacttattctaaagccagctctatcccaagttaaataacttgataagtataatattttcagtttataggccattgtttaaaattgtgtatataacttcatatgcttatgaagtaaattagaagcattttacatacatttgtttccaattctttttcaccaagtatctnatccccagcccncccatcttcccccacccccagcccttggccacagacctgcagagaacttttgcgtactcttttgaggcctcacctgtatgtagttccctcttctccagtaccttattctataaactcccaacatgttagcactgtaagactctcagcttagtgacagtgacattgcctcatttctggaggtctctacctctctccgtgtggtcaagaaactgccattgggcagaaaacacaagtgtgtatgagatttgcctccagtgttttcctgttctcaaatatcacagtcctgttctgcctgtgttccaatctctgaaaacagttttctcaaatattctatccagtttcagttttctcgttggtcatggtgggagggcaagtccatcttggctggaagaggaagtccttctgcgtctttttctctttgtccttccacatggttttgcattgtggattttctaaacttgccgtataagtaagcatgtgcctatttgtgaagggaaaga

SEQ ID NO: 30318 - DNA, 1552 bp, Homo sapiens
  misc_feature (1)..(1): n is a, c, g, or t
ngcgtcatacacctgcacccgggaggaaaggcgaggctctgcatctagatttacctcgttctcttttgtctccgcttttttttcacatttccttgcgaccctggcccttgagcgacaaaaaggggaagccaaggctggcccgaggaacggagagggcacatggcctagccacaagtggagcttctgctccgcccgaagggatgcgctggagcggcctcttccttctgccacggtctttctttgccaactagtaggtggagactggacctcagaagagggagtgggtgccccgagaactcacagctagcggacagtggaaagggcaggagccggaccaaggtgaggacagtggaactgaaggccgctggttacctctcctgccctccgctggccacagtggagaagacagcccctccctcctgctctgacctgacagtgttcatccatcgccctgtattagcgaagaacaacatcaagctggctagcaaggaactgtatacagggtccagctgggtatcacactggatctcacccaaagcttagatgtgatccagctcagtatcacaaagcagaacgaaaaggatgtgtttgggctgagaggccatacattggctccggcatgacgggtgacttcttccgagtctggcttctgcagcacacagggcttcgccagcacccagctcctgcagcatgggcagctcctgtgacagcaggcgcccgcagcctgcaaagcgtctccagtgccgccgcctcagtgaacctcaaccagcggcacctagcagctttctctgccaccctcttcaggtagttctgtagcagcgcgtttctcatgagacacttccctgtgagcagctttttctacccttgaggatggatttccagcaaattctgcccatgtggtaccacagccacttctctgccattcagtgaaactgccgttgtgccctcttcaaggtctggatctaagcccagggaccaggaaacctcttgcttgagtgctggaactcaggccagaaggtatggctgctgctatgtgctgtgaccagagaatcagagttctctttacttcttaccagccaacctcttgaaaatgcctttttgttttttgtttttttttgagacggagtctcgctctgttgcccaggcagtgcagtggctcactgcaacctccgcctcctgagttcaagtgattctcctgcctcagcctcacaagtaggtgggattacaggcatgtgccaccacgcccagctaattttgtatttttagtagtgacggggtttctccatgttggtcaggttggtctcaaactctcgacctcaggtgatccacctgtctcagcctcccaaagtgctgggattacagacgttagccagagcgcccagtctaagccctttatagcttaattctatatattaaattttcccagttcaaattactgtgtgcttcccttctcctgattgggaccttgcttgatacaaaattagtacaaggagtggtctcaagagatagatgcacaaagaagaggatatggggacggatttgggtatttggg

SEQ ID NO: 30319 - DNA, 1132 bp, Homo sapiens
  misc_feature (1)..(1): n is a, c, g, or t
ngcgtcatacacctgcacccgggaggaaaggcgaggctctgcatctagatttacctcgttctcttttgtctccgcttttttttcacatttccttgcgaccctggcccttgagcgacaaaaaggggaagccaaggctggcccgaggaacggagagggcacatggcctagccacaagtggagcttctgctccgcccgaagggatgcgctggagcggcctcttccttctgccacggtctttctttgccaactagtagagatggggtttcaccaggttagccaggctggtcttgaactccagacctcaagggatccgcctgcctcagctttccaaagtgctgggattacaggtggagactggacctcagaagagggagtgggtgccccgagaactcacagctagcggacagtggaaagggcaggagccggaccaaggctccggcatgacgggtgacttcttccgagtctggcttctgcagcacacagggcttcgccagcacccagctcctgcagcatgggcagctcctgtgacagcaggcgcccgcagcctgcaaagcgtctccagtgccgccgcctcagtgaacctcaaccagcggcacctagcagctttctctgccaccctcttcaggtctggatctaagcccagggaccaggaaacctcttgcttgagtgctggaactcaggccagaaggcaggaagcccgcctgaccccatgtctcaggctgccagaggagcgtgcgatgaggaaggctggactgtcttcacaggacaccagggagaagcctcaagccactgccccctgacaagtcgcagctctccagcctgtctcctcactcccctcccctccacatgggggggttggggtgggggcggggaaggttcggggcaggggtcatttcagctactgggcaccagtctcctcctcatgtttatcctgttccctttgcttgaaaggttcgtactccagatccttgtaaaaccgcttctcaccctttgagtctcagcttaaatgtcccctccttggaggggtcttccctgacaatgaagctccgaccgtcctctcctgttttacccagttcatttctttctggcatttgtaactacttgaagttaaagtgtgtgccatgtatgtgtc

SEQ ID NO: 30320 - DNA, 915 bp, Homo sapiens
  misc_feature (1)..(1): n is a, c, g, or t
ngcgtcatacacctgcacccgggaggaaaggcgaggctctgcatctagatttacctcgttctcttttgtctccgcttttttttcacatttccttgcgaccctggcccttgagcgacaaaaaggggaagccaaggctggcccgaggaacggagagggcacatggcctagccacaagtggagcttctgctccgcccgaagggatgcgctggagcggcctcttccttctgccacggtctttctttgccaactagtaggtgagggccgaaaggccgcgggccgtggagctcgggccggggagactcttttctagcctcttgggtcccgctcctcccaattccctggagaggcgtcgagcttgctgggaagtgccctcgggtaaggggcgcggagcctcctgcggcgatcctctgtcttcgggtcgccttagcaggacgcggcaagcgggacactgacctggccggagtcccgcgttctctcaccagctgctttgtccacgagttgctgctgggcgtcaggggtcccacggcccggagggatctagagcaggggggctcggggtcctttccataccctcggatcctctcccactctctccacgcctcgacccggagatgatttcaggctccagatctctttcataaatggaaagagtttttttggtttgttttgtcttaattatgtaggtgttgcatgcttggaagagaaaatttagaaaattaattggaaaaccataaagatagctttctcgtgatagccacaaggcttgctccctcattctgctcatatgtcaccccctcaaggaggccttccccagctctgtaaacaacctgtgctcggcgttaacttttctccctaatgtttatcactacctgacatatacgtgtttcccacgactcaacgataagtgttcatgag

SEQ ID NO: 30321 - DNA, 320 bp, Homo sapiens
cgtgcgaatctcctcctcctgttacttttaatctttgtgtctgtaaactaaagtgggtttctagttgataacatataggtgggctctagctcgattaattcactcgtactaatctctgtcttttaattggtatattgaaccacagtgattatggatatagtctggacttaattctatatattaaattttcccagttcaaattactgtgtgcttcccttctcctgattgggaccttgcttgatacaaaattagtacaaggagtggtctcaagagatagatgcacaaagaagaggatatggggacggatttgggtatttggg

SEQ ID NO: 30322 - DNA, 2581 bp, Homo sapiens
  misc_feature (1)..(1): n is a, c, g, or t
ngcgtcatacacctgcacccgggaggaaaggcgaggctctgcatctagatttacctcgttctcttttgtctccgcttttttttcacatttccttgcgaccctggcccttgagcgacaaaaaggggaagccaaggctggcccgaggaacggagagggcacatggcctagccacaagtggagcttctgctccgcccgaagggatgcgctggagcggcctcttccttctgccacggtctttctttgccaactagtaggtggagactggacctcagaagagggagtgggtgccccgagaactcacagctagcggacagtggaaagggcaggagccggaccaaggtgaggacagtggaactgaaggccgctggttacctctcctgccctccgctggccacagtggagaagacagcccctccctcctgctctgacctgacagtgttcatccatcgccctgtattagcgaagaacaacatcaagctggctagcaaggaactgtatacagggtccagctgggtatcacactggatctcacccaaagcttagatgtgatccagctcagtatcacaaagcagaacgaaaaggatgtgtttgggctgagaggccatacattggtaagtggcacatgaactgtattttctattgagcattgctggtatatggcaaatttgcataaaattatattgaaattgactaccggattgcactttcttgttccttctgataatttttcacgtgttctttttctttcttactttagatggagtctcgctctgtcgcccaggctggagtccagtggcgcgatctcggttcactgcaagctccgcctcccgagttcatgccattctcctgcctcagcctcctgagtagctgggactacaggcacctgccaccacggctggctaatttttttttttttttttttgaaatggagtcttgactccagtctggatgacagagcaatactccgtctcacaaaaaagaaaatatagtctataaataatgaagaaagtaaagtgaacctgggaggtggaggttatagtgagctgagatcatggcactgcacttcagcctgggcagcagcaagactccgtctcaaaaaaaaaaaaaaaagaaatatgcgagctgctaagctaggcagttctggctcaagatctctcatgatactgcagacaccacaccaacgaggaccccagtcctctggcactggaggacccacttagaaggcggatgactcacgtggctcttggcaggaagacctcagttcctccccacataggcctccctataggactgcttgagtgtcccgtttaccaaatgatctaaatatgttccggttttgattggctgctctgcaatgtgggccgttatctagctgattcggtggggcctgaagtgtcagttcctgccgcagggatgttatatggaacctttggcaggccgctacagacgaatcataatataaacctgtgctagttattgattacgtcccagctcctgcgttgcctgctctgtgaaatggttctggccctttagtttttcctttaccagctggcatgatcttaagctttgtcagtagagggcgctggagagacattgcaggagacgagtttcccttcctgcttctggtgtgttctctctaggctccggcatgacgggtgacttcttccgagtctggcttctgcagcacacagggcttcgccagcacccagctcctgcagcatgggcagctcctgtgacagcaggcgcccgcagcctgcaaagcgtctccagtgccgccgcctcagtgaacctcaaccagcggcacctagcagctttctctgccaccctcttcaggtagttctgtagcagcgcgtttctcatgagacacttccctgtgagcagctttttctacccttgaggatggatttccagcaaattctgcccatgtggtaccacagccacttctctgccattcagtgaaactgccgttgtgccctcttcaaggtctggatctaagcccagggaccaggaaacctcttgcttgagtgctggaactcaggccagaaggtatggctgctgctatgtgctgtgaccagagaatcagagttctctttacttcttaccagccaacctcttgaaaatgcctttttgttttttgtttttttttgagacggagtctcgctctgttgcccaggcagtgcagtggctcactgcaacctccgcctcctgagttcaagtgattctcctgcctcagcctcacaagtaggtgggattacaggcatgtgccaccacgcccagctaattttgtatttttagtagtgacggggtttctccatgttggtcaggttggtctcaaactctcgacctcaggtgatccacctgtctcagcctcccaaagtgctgggattacagacgttagccagagcgcccagtctaagccctttatagcttaattctatatattaaattttcccagttcaaattactgtgtgcttcccttctcctgattgggaccttgcttgatacaaaattagtacaaggagtggtctcaagagatagatgcacaaagaagaggatatggggacggatttgggtatttggg

SEQ ID NO: 30323 - DNA, 2927 bp, Homo sapiens
  misc_feature (1)..(1): n is a, c, g, or t
ngcgtcatacacctgcacccgggaggaaaggcgaggctctgcatctagatttacctcgttctcttttgtctccgcttttttttcacatttccttgcgaccctggcccttgagcgacaaaaaggggaagccaaggctggcccgaggaacggagagggcacatggcctagccacaagtggagcttctgctccgcccgaagggatgcgctggagcggcctcttccttctgccacggtctttctttgccaactagtagatttggacatttacagtgttcagccgttgttgtggcattccaattcaattgggaaacagcttgatgtagcgtccccataaggtccacagtaattaaattttttttttttttttttggtgcggtagtgcaatttcatggctcactgcaacctccacctcccaggttcaagcgatcctcccatctcagcctccctagtagctgggattacaggtgcacgccaccacaccaggctaatttttggtatttttagtagagatggggtttcaccaggttagccaggctggtcttgaactccagacctcaagggatccgcctgcctcagctttccaaagtgctgggattacaggtggagactggacctcagaagagggagtgggtgccccgagaactcacagctagcggacagtggaaagggcaggagccggaccaaggtgaggacagtggaactgaaggccgctggttacctctcctgccctccgctggccacagtggagaagacagcccctccctcctgctctgacctgacagtgttcatccatcgccctgtattagcgaagaacaacatcaagctggctagcaaggaactgtatacagggtccagctgggtatcacactggatctcacccaaagcttagatgtgatccagctcagtatcacaaagcagaacgaaaaggatgtgtttgggctgagaggccatacattggtaagtggcacatgaactgtattttctattgagcattgctggtatatggcaaatttgcataaaattatattgaaattgactaccggattgcactttcttgttccttctgataatttttcacgtgttctttttctttcttactttagatggagtctcgctctgtcgcccaggctggagtccagtggcgcgatctcggttcactgcaagctccgcctcccgagttcatgccattctcctgcctcagcctcctgagtagctgggactacaggcacctgccaccacggctggctaatttttttttttttttttttgaaatggagtcttgactccagtctggatgacagagcaatactccgtctcacaaaaaagaaaatatagtctataaataatgaagaaagtaaagtgaacctgggaggtggaggttatagtgagctgagatcatggcactgcacttcagcctgggcagcagcaagactccgtctcaaaaaaaaaaaaaaaagaaatatgcgagctgctaagctaggcagttctggctcaagatctctcatgatactgcagacaccacaccaacgaggaccccagtcctctggcactggaggacccacttagaaggcggatgactcacgtggctcttggcaggaagacctcagttcctccccacataggcctccctataggactgcttgagtgtcccgtttaccaaatgatctaaatatgttccggttttgattggctgctctgcaatgtgggccgttatctagctgattcggtggggcctgaagtgtcagttcctgccgcagggatgttatatggaacctttggcaggccgctacagacgaatcataatataaacctgtgctagttattgattacgtcccagctcctgcgttgcctgctctgtgaaatggttctggccctttagtttttcctttaccagctggcatgatcttaagctttgtcagtagagggcgctggagagacattgcaggagacgagtttcccttcctgcttctggtgtgttctctctaggctccggcatgacgggtgacttcttccgagtctggcttctgcagcacacagggcttcgccagcacccagctcctgcagcatgggcagctcctgtgacagcaggcgcccgcagcctgcaaagcgtctccagtgccgccgcctcagtgaacctcaaccagcggcacctagcagctttctctgccaccctcttcaggtagttctgtagcagcgcgtttctcatgagacacttccctgtgagcagctttttctacccttgaggatggatttccagcaaattctgcccatgtggtaccacagccacttctctgccattcagtgaaactgccgttgtgccctcttcaaggtctggatctaagcccagggaccaggaaacctcttgcttgagtgctggaactcaggccagaaggtatggctgctgctatgtgctgtgaccagagaatcagagttctctttacttcttaccagccaacctcttgaaaatgcctttttgttttttgtttttttttgagacggagtctcgctctgttgcccaggcagtgcagtggctcactgcaacctccgcctcctgagttcaagtgattctcctgcctcagcctcacaagtaggtgggattacaggcatgtgccaccacgcccagctaattttgtatttttagtagtgacggggtttctccatgttggtcaggttggtctcaaactctcgacctcaggtgatccacctgtctcagcctcccaaagtgctgggattacagacgttagccagagcgcccagtctaagccctttatagcttaattctatatattaaattttcccagttcaaattactgtgtgcttcccttctcctgattgggaccttgcttgatacaaaattagtacaaggagtggtctcaagagatagatgcacaaagaagaggatatggggacggatttgggtatttggg

SEQ ID NO: 30324 - DNA, 2442 bp, Homo sapiens
tttctaagagttacagaatagcaactgcaggaaggaacttgtgcccttaggactgaggaagtaaaaaggagggaaacttggaaacacgaaagagcccttcccctttcaattcaaggtggagactggacctcagaagagggagtgggtgccccgagaactcacagctagcggacagtggaaagggcaggagccggaccaaggtgaggacagtggaactgaaggccgctggttacctctcctgccctccgctggccacagtggagaagacagcccctccctcctgctctgacctgacagtgttcatccatcgccctgtattagcgaagaacaacatcaagctggctagcaaggaactgtatacagggtccagctgggtatcacactggatctcacccaaagcttagatgtgatccagctcagtatcacaaagcagaacgaaaaggatgtgtttgggctgagaggccatacattggtaagtggcacatgaactgtattttctattgagcattgctggtatatggcaaatttgcataaaattatattgaaattgactaccggattgcactttcttgttccttctgataatttttcacgtgttctttttctttcttactttagatggagtctcgctctgtcgcccaggctggagtccagtggcgcgatctcggttcactgcaagctccgcctcccgagttcatgccattctcctgcctcagcctcctgagtagctgggactacaggcacctgccaccacggctggctaatttttttttttttttttttgaaatggagtcttgactccagtctggatgacagagcaatactccgtctcacaaaaaagaaaatatagtctataaataatgaagaaagtaaagtgaacctgggaggtggaggttatagtgagctgagatcatggcactgcacttcagcctgggcagcagcaagactccgtctcaaaaaaaaaaaaaaaagaaatatgcgagctgctaagctaggcagttctggctcaagatctctcatgatactgcagacaccacaccaacgaggaccccagtcctctggcactggaggacccacttagaaggcggatgactcacgtggctcttggcaggaagacctcagttcctccccacataggcctccctataggactgcttgagtgtcccgtttaccaaatgatctaaatatgttccggttttgattggctgctctgcaatgtgggccgttatctagctgattcggtggggcctgaagtgtcagttcctgccgcagggatgttatatggaacctttggcaggccgctacagacgaatcataatataaacctgtgctagttattgattacgtcccagctcctgcgttgcctgctctgtgaaatggttctggccctttagtttttcctttaccagctggcatgatcttaagctttgtcagtagagggcgctggagagacattgcaggagacgagtttcccttcctgcttctggtgtgttctctctaggctccggcatgacgggtgacttcttccgagtctggcttctgcagcacacagggcttcgccagcacccagctcctgcagcatgggcagctcctgtgacagcaggcgcccgcagcctgcaaagcgtctccagtgccgccgcctcagtgaacctcaaccagcggcacctagcagctttctctgccaccctcttcaggtagttctgtagcagcgcgtttctcatgagacacttccctgtgagcagctttttctacccttgaggatggatttccagcaaattctgcccatgtggtaccacagccacttctctgccattcagtgaaactgccgttgtgccctcttcaaggtctggatctaagcccagggaccaggaaacctcttgcttgagtgctggaactcaggccagaaggtatggctgctgctatgtgctgtgaccagagaatcagagttctctttacttcttaccagccaacctcttgaaaatgcctttttgttttttgtttttttttgagacggagtctcgctctgttgcccaggcagtgcagtggctcactgcaacctccgcctcctgagttcaagtgattctcctgcctcagcctcacaagtaggtgggattacaggcatgtgccaccacgcccagctaattttgtatttttagtagtgacggggtttctccatgttggtcaggttggtctcaaactctcgacctcaggtgatccacctgtctcagcctcccaaagtgctgggattacagacgttagccagagcgcccagtctaagccctttatagcttaattctatatattaaattttcccagttcaaattactgtgtgcttcccttctcctgattgggaccttgcttgatacaaaattagtacaaggagtggtctcaagagatagatgcacaaagaagaggatatggggacggatttgggtatttggg

SEQ ID NO: 30325 - DNA, 2764 bp, Homo sapiens
tgtacatgtttccaaactgtcctccagaaagaatgtaatgctttgaacttccacttgagaatcaaatgtttaccttcctctgttcctccagatttggacatttacagtgttcagccgttgttgtggcattccaattcaattgggaaacagcttgatgtagcgtccccataaggtccacagtaattaaattttttttttttttttttggtgcggtagtgcaatttcatggctcactgcaacctccacctcccaggttcaagcgatcctcccatctcagcctccctagtagctgggattacaggtgcacgccaccacaccaggctaatttttggtatttttagtagagatggggtttcaccaggttagccaggctggtcttgaactccagacctcaagggatccgcctgcctcagctttccaaagtgctgggattacaggtggagactggacctcagaagagggagtgggtgccccgagaactcacagctagcggacagtggaaagggcaggagccggaccaaggtgaggacagtggaactgaaggccgctggttacctctcctgccctccgctggccacagtggagaagacagcccctccctcctgctctgacctgacagtgttcatccatcgccctgtattagcgaagaacaacatcaagctggctagcaaggaactgtatacagggtccagctgggtatcacactggatctcacccaaagcttagatgtgatccagctcagtatcacaaagcagaacgaaaaggatgtgtttgggctgagaggccatacattggtaagtggcacatgaactgtattttctattgagcattgctggtatatggcaaatttgcataaaattatattgaaattgactaccggattgcactttcttgttccttctgataatttttcacgtgttctttttctttcttactttagatggagtctcgctctgtcgcccaggctggagtccagtggcgcgatctcggttcactgcaagctccgcctcccgagttcatgccattctcctgcctcagcctcctgagtagctgggactacaggcacctgccaccacggctggctaatttttttttttttttttttgaaatggagtcttgactccagtctggatgacagagcaatactccgtctcacaaaaaagaaaatatagtctataaataatgaagaaagtaaagtgaacctgggaggtggaggttatagtgagctgagatcatggcactgcacttcagcctgggcagcagcaagactccgtctcaaaaaaaaaaaaaaaagaaatatgcgagctgctaagctaggcagttctggctcaagatctctcatgatactgcagacaccacaccaacgaggaccccagtcctctggcactggaggacccacttagaaggcggatgactcacgtggctcttggcaggaagacctcagttcctccccacataggcctccctataggactgcttgagtgtcccgtttaccaaatgatctaaatatgttccggttttgattggctgctctgcaatgtgggccgttatctagctgattcggtggggcctgaagtgtcagttcctgccgcagggatgttatatggaacctttggcaggccgctacagacgaatcataatataaacctgtgctagttattgattacgtcccagctcctgcgttgcctgctctgtgaaatggttctggccctttagtttttcctttaccagctggcatgatcttaagctttgtcagtagagggcgctggagagacattgcaggagacgagtttcccttcctgcttctggtgtgttctctctaggctccggcatgacgggtgacttcttccgagtctggcttctgcagcacacagggcttcgccagcacccagctcctgcagcatgggcagctcctgtgacagcaggcgcccgcagcctgcaaagcgtctccagtgccgccgcctcagtgaacctcaaccagcggcacctagcagctttctctgccaccctcttcaggtagttctgtagcagcgcgtttctcatgagacacttccctgtgagcagctttttctacccttgaggatggatttccagcaaattctgcccatgtggtaccacagccacttctctgccattcagtgaaactgccgttgtgccctcttcaaggtctggatctaagcccagggaccaggaaacctcttgcttgagtgctggaactcaggccagaaggtatggctgctgctatgtgctgtgaccagagaatcagagttctctttacttcttaccagccaacctcttgaaaatgcctttttgttttttgtttttttttgagacggagtctcgctctgttgcccaggcagtgcagtggctcactgcaacctccgcctcctgagttcaagtgattctcctgcctcagcctcacaagtaggtgggattacaggcatgtgccaccacgcccagctaattttgtatttttagtagtgacggggtttctccatgttggtcaggttggtctcaaactctcgacctcaggtgatccacctgtctcagcctcccaaagtgctgggattacagacgttagccagagcgcccagtctaagccctttatagcttaattctatatattaaattttcccagttcaaattactgtgtgcttcccttctcctgattgggaccttgcttgatacaaaattagtacaaggagtggtctcaagagatagatgcacaaagaagaggatatggggacggatttgggtatttggg

SEQ ID NO: 30326 - DNA, 2490 bp, Homo sapiens
  misc_feature (1)..(1): n is a, c, g, or t
ngcgtcatacacctgcacccgggaggaaaggcgaggctctgcatctagatttacctcgttctcttttgtctccgcttttttttcacatttccttgcgaccctggcccttgagcgacaaaaaggggaagccaaggctggcccgaggaacggagagggcacatggcctagccacaagtggagcttctgctccgcccgaagggatgcgctggagcggcctcttccttctgccacggtctttctttgccaactagtaggtggagactggacctcagaagagggagtgggtgccccgagaactcacagctagcggacagtggaaagggcaggagccggaccaaggtgaggacagtggaactgaaggccgctggttacctctcctgccctccgctggccacagtggagaagacagcccctccctcctgctctgacctgacagtgttcatccatcgccctgtattagcgaagaacaacatcaagctggctagcaaggaactgtatacagggtccagctgggtatcacactggatctcacccaaagcttagatgtgatccagctcagtatcacaaagcagaacgaaaaggatgtgtttgggctgagaggccatacattggtaagtggcacatgaactgtattttctattgagcattgctggtatatggcaaatttgcataaaattatattgaaattgactaccggattgcactttcttgttccttctgataatttttcacgtgttctttttctttcttactttagatggagtctcgctctgtcgcccaggctggagtccagtggcgcgatctcggttcactgcaagctccgcctcccgagttcatgccattctcctgcctcagcctcctgagtagctgggactacaggcacctgccaccacggctggctaatttttttttttttttttttgaaatggagtcttgactccagtctggatgacagagcaatactccgtctcacaaaaaagaaaatatagtctataaataatgaagaaagtaaagtgaacctgggaggtggaggttatagtgagctgagatcatggcactgcacttcagcctgggcagcagcaagactccgtctcaaaaaaaaaaaaaaaagaaatatgcgagctgctaagctaggcagttctggctcaagatctctcatgatactgcagacaccacaccaacgaggaccccagtcctctggcactggaggacccacttagaaggcggatgactcacgtggctcttggcaggaagacctcagttcctccccacataggcctccctataggactgcttgagtgtcccgtttaccaaatgatctaaatatgttccggttttgattggctgctctgcaatgtgggccgttatctagctgattcggtggggcctgaagtgtcagttcctgccgcagggatgttatatggaacctttggcaggccgctacagacgaatcataatataaacctgtgctagttattgattacgtcccagctcctgcgttgcctgctctgtgaaatggttctggccctttagtttttcctttaccagctggcatgatcttaagctttgtcagtagagggcgctggagagacattgcaggagacgagtttcccttcctgcttctggtgtgttctctctaggctccggcatgacgggtgacttcttccgagtctggcttctgcagcacacagggcttcgccagcacccagctcctgcagcatgggcagctcctgtgacagcaggcgcccgcagcctgcaaagcgtctccagtgccgccgcctcagtgaacctcaaccagcggcacctagcagctttctctgccaccctcttcaggtagttctgtagcagcgcgtttctcatgagacacttccctgtgagcagctttttctacccttgaggatggatttccagcaaattctgcccatgtggtaccacagccacttctctgccattcagtgaaactgccgttgtgccctcttcaaggtctggatctaagcccagggaccaggaaacctcttgcttgagtgctggaactcaggccagaaggcaggaagcccgcctgaccccatgtctcaggctgccagaggagcgtgcgatgaggaaggctggactgtcttcacaggacaccagggagaagcctcaagccactgccccctgacaagtcgcagctctccagcctgtctcctcactcccctcccctccacatgggggggttggggtgggggcggggaaggttcggggcaggggtcatttcagctactgggcaccagtctcctcctcatgtttatcctgttccctttgcttgaaaggttcgtactccagatccttgtaaaaccgcttctcaccctttgagtctcagcttaaatgtcccctccttggaggggtcttccctgacaatgaagctccgaccgtcctctcctgttttacccagttcatttctttctggcatttgtaactacttgaagttaaagtgtgtgccatgtatgtgtc

SEQ ID NO: 30327 - DNA, 2277 bp, Homo sapiens
  misc_feature (1)..(1): n is a, c, g, or t
ngcgtcatacacctgcacccgggaggaaaggcgaggctctgcatctagatttacctcgttctcttttgtctccgcttttttttcacatttccttgcgaccctggcccttgagcgacaaaaaggggaagccaaggctggcccgaggaacggagagggcacatggcctagccacaagtggagcttctgctccgcccgaagggatgcgctggagcggcctcttccttctgccacggtctttctttgccaactagtaggtggagactggacctcagaagagggagtgggtgccccgagaactcacagctagcggacagtggaaagggcaggagccggaccaaggtgaggacagtggaactgaaggccgctggttacctctcctgccctccgctggccacagtggagaagacagcccctccctcctgctctgacctgacagtgttcatccatcgccctgtattagcgaagaacaacatcaagctggctagcaaggaactgtatacagggtccagctgggtatcacactggatctcacccaaagcttagatgtgatccagctcagtatcacaaagcagaacgaaaaggatgtgtttgggctgagaggccatacattggtaagtggcacatgaactgtattttctattgagcattgctggtatatggcaaatttgcataaaattatattgaaattgactaccggattgcactttcttgttccttctgataatttttcacgtgttctttttctttcttactttagatggagtctcgctctgtcgcccaggctggagtccagtggcgcgatctcggttcactgcaagctccgcctcccgagttcatgccattctcctgcctcagcctcctgagtagctgggactacaggcacctgccaccacggctggctaatttttttttttttttttttgaaatggagtcttgactccagtctggatgacagagcaatactccgtctcacaaaaaagaaaatatagtctataaataatgaagaaagtaaagtgaacctgggaggtggaggttatagtgagctgagatcatggcactgcacttcagcctgggcagcagcaagactccgtctcaaaaaaaaaaaaaaaagaaatatgcgagctgctaagctaggcagttctggctcaagatctctcatgatactgcagacaccacaccaacgaggaccccagtcctctggcactggaggacccacttagaaggcggatgactcacgtggctcttggcaggaagacctcagttcctccccacataggcctccctataggactgcttgagtgtcccgtttaccaaatgatctaaatatgttccggttttgattggctgctctgcaatgtgggccgttatctagctgattcggtggggcctgaagtgtcagttcctgccgcagggatgttatatggaacctttggcaggccgctacagacgaatcataatataaacctgtgctagttattgattacgtcccagctcctgcgttgcctgctctgtgaaatggttctggccctttagtttttcctttaccagctggcatgatcttaagctttgtcagtagagggcgctggagagacattgcaggagacgagtttcccttcctgcttctggtgtgttctctctaggctccggcatgacgggtgacttcttccgagtctggcttctgcagcacacagggcttcgccagcacccagctcctgcagcatgggcagctcctgtgacagcaggcgcccgcagcctgcaaagcgtctccagtgccgccgcctcagtgaacctcaaccagcggcacctagcagctttctctgccaccctcttcaggcaggaagcccgcctgaccccatgtctcaggctgccagaggagcgtgcgatgaggaaggctggactgtcttcacaggacaccagggagaagcctcaagccactgccccctgacaagtcgcagctctccagcctgtctcctcactcccctcccctccacatgggggggttggggtgggggcggggaaggttcggggcaggggtcatttcagctactgggcaccagtctcctcctcatgtttatcctgttccctttgcttgaaaggttcgtactccagatccttgtaaaaccgcttctcaccctttgagtctcagcttaaatgtcccctccttggaggggtcttccctgacaatgaagctccgaccgtcctctcctgttttacccagttcatttctttctggcatttgtaactacttgaagttaaagtgtgtgccatgtatgtgtc

SEQ ID NO: 30328 - DNA, 855 bp, Homo sapiens
ctaacctggccttcttcaaatggcagaagagttaacagcagcaaaagaaggcattgatgggaggcaaacaaaagttggagcatttgttgaaagcagacttgccttacaggatacgtcatggaacagagggcaacctgcctcctggaaatgtggagtgtctagggagtcacagctgagatcttccttggattaaaggctgcgggtgtcacaaacaggatgctgtaacaacaccataaactttcaaacaactctatttcctacggttctggaggctggaagtccacaatcaaagtgtcatgttgtcaggttgtggtgagggccctcttttgggtgtagattgctaacttttctgtatgtgttcacatggcagaaagaaattgagctagctcttggatcctttcttataagggcaccaatcccaatacagaggcttcactctcatgacataattgtctcccaaagactctacctccaaatattatcaatcaatcacattaggggatagattttaacacatgattttggggggaacacattcagtccataacatttcttgagtcttcttctaggacccataggttattttaaaagtggcttgttcagttccaagtgtttgaagattttttttttctgttatctttaacttactgatttctagatagaccccattgtgctcagagaacactccttatgtgatttcaattattttaaatttgttgagattttatgacttagtatgtcatctgtcttggtgtgtattctgtgggggggatggggggtgcttgaaaaacgggtattctgctattatagaatgtcaaaatatcaactgtaataaacaagaaaaataatcctagt

SEQ ID NO: 30329 - DNA, 1088 bp, Homo sapiens
tacacactaaaactcccacagaaagggggaaaattagaaaaggggtgatataatttgactctgtgtcaccacccaaatctcatcttgaattgtaatccccgtaatttctcacctggcaagagtgggaccaggtggagacaattggatcatgggggcagttttccccatgctcttctcgtgataatgattgagtctcatgggatctgatgattctataagtgtctggcttttctcctacttgcactcactccatcctgccaccctgcgaggaaggtgcctgcttcttctttgccttccgccgtgagtgtgagtctcctgaggcctccccagcaatgtggaactgatacgtcatggaacagagggcaacctgcctcctggaaatgtggagtgtctagggagtcacagctgagatcttccttggattaaaggctgcgggtgtcacaaacaggatgctgtaacaacaccataaactttcaaacaactctatttcctacggttctggaggctggaagtccacaatcaaagtgtcatgttgtcaggttgtggtgagggccctcttttgggtgtagattgctaacttttctgtatgtgttcacatggcagaaagaaattgagctagctcttggatcctttcttataagggcaccaatcccaatacagaggcttcactctcatgacataattgtctcccaaagactctacctccaaatattatcaatcaatcacattaggggatagattttaacacatgattttggggggaacacattcagtccataacatttcttgagtcttcttctaggacccataggttattttaaaagtggcttgttcagttccaagtgtttgaagattttttttttctgttatctttaacttactgatttctagatagaccccattgtgctcagagaacactccttatgtgatttcaattattttaaatttgttgagattttatgacttagtatgtcatctgtcttggtgtgtattctgtgggggggatggggggtgcttgaaaaacgggtattctgctattatagaatgtcaaaatatcaactgtaataaacaagaaaaataatcctagt

SEQ ID NO: 30330 - DNA, 366 bp, Homo sapiens
gtcaaggtgggaggactgcttgggcccaggagttcgagtccagcctgggcaacatagggagatctcgtctctacagaaaatttttaaatttagctgggtgtgtggtgtgcacctgtggccccagctaactacttgggaggcagaggcaggaggatcacttgagcctaggaggatgaagctgacttctgagtttaaagtgttcggagaattgtgcaggtgtaatttatctgtgaccaacaagaagagcaaccagttactattagcaaaagggagatggaagactaataggtgccgctacactccagtctgggtgacaaagttagaccgtatctctaaataagtaaaaaataaatataccattaaatc

SEQ ID NO: 30331 - DNA, 506 bp, Homo sapiens
gaggggcgggctcaaaggccaggaacctcaagtcacttgagtctggcagcgtcaagggacaccccatgctgggtgtgccgtcttctctttgcatagaatcttgagctgatgatggttttgtgggttttttattaagagaaaaggcttactgaacgctttatatgcatcaattcatgagtccgtaccacagcctatgagatgttacactcatttcacagatggagaaactgaggccagaagaggtgagcttacctgcccaaggcatctagtgaccagaggggcagccagggtgtgatcctgcctcatctgacttcgtagttgggtacacatttaacttccgccttcctgtgtgtgttttccaagagcatcattaaaaagttttggccgggtgcggtggctcacgcgtgtaatcccagcactttgggaggccgacgtgagtagatcacctgaggtcaggatttcgagaccagcctggccaacatggcaaaactctgtctctactaaaa

SEQ ID NO: 30332 - DNA, 483 bp, Homo sapiens
gaggcttgctctgttgcccaggctggagtgcaatgtcacgatcttggcttactgcaacctctgactcccaggttcaagcgattctcatgcctcagcctcctgagtagcggggatatttgtgtgtgtgtgtgcgcgcatttggttttccatctgtgtcctctactaaaaagtttcattaaagcagggattctactgtgtctactcagtagcttcgaggtctatcctataatgggcactcaggaaatatttgttgattgggtgtagttttgtgaatatgctcatgaccatgtggtcattctaaagggctttattatttgtgagtggagcctgtatatttttccagcagcctgcctcccttcgtacagggccctgagaaatggaataatcccattactagtgaatgaacaatcagtttctatgtctatatcccactccaaactgaacctgaaggcagattctatgtccttcttcttaatagttatt

SEQ ID NO: 30333 - DNA, 451 bp, Homo sapiens
agtttcagaaattgtgttcctttggactgtagttcttcccatcagtatcaactcagatctgggcaagagggggcctagctctgagctgctccccatcatatagaggcaaagatctcttgaaagcaatgggtatgccccaccctagagtctgaacccatcccttttgggatcacattctgtttataaaagattccccaaattccctttccaagcagtcttcaggacatctaggagcctgcaaggatttcttcctggggcagtcaagcagactgcattgcccatgtgtacactctaagcctgagggatggccaagaaatgactctctgcaaggagtgggaatgagctgcagcgtgctggggttgggatgctcatgtgtgtgcaccaccacctcttcccaaagcaagtcacagctttgacaacagtaaaataaattttcaacttgcactgtccg

SEQ ID NO: 30334 - DNA, 756 bp, Homo sapiens
ataatattttatactttttatttccccaaatggctaacatatatagttggtgcttaaaaaatatttgagtaacttttctttaaccccatcaaccagattctaggaagcattttgacttggttctcagaactcggaggctggaagcttgttctccaatgcgtagggcagtacaaggaggcctcagcctttagtaagtaagaaggtaggtttctcttggtgccctgggaaaattttggttaacagatgtttggggtacttatttgtttggctctgtagccttagaccaggtctttgaataaatatttccatcactgtttccttttctcagtggcgaaaaatgccagtgttttctgagcaatcccctctcctttagagtttagggtgagccagttagtgcccagacgcaaatctgtgtcttaggggaagagccatccaataggagagtaatgtttagagcctgggctctggggtcagattgggttcaaattctgcctctgccacctaatagctctgtaaccttggacaagttacttgtccgtgccctggttcctcttccgtaaaattgaggcagtggtagcattatctcatggggctgtaacaaagcctaaatgccaaatgtaaagtgcctagaatagtacttcctgcctccttgctgaacaaaatgtttgcagttattgttttgtttattattctcttgtaaaccaagtagtgtttagttccttttttttttttccagacagagtctcactgtcgccc

SEQ ID NO: 30335 - DNA, 1374 bp, Homo sapiens
taaaaaagcacctttttttgttgtttccccttaataaaagaggtttctaatttatgtttctctaagatttccttgggttgtatttagaaacacaaatagttttataatcaggattgcatttgtgctgggtaaaagaggagagctgtgctttctaccccaaagttgttggtaatggagccggtctgcccttcctacaaactcaagaggctcattgttcaaggtgtaacaacatttaattgcatgtcctctaacgctttgaaacctttagagggaagatcctcattttttacaattttgttccttttcatcatagaaaacatgtttaagataaaatacaaactttacctaccccaaattcataaagtacatttagtgctgtatagcactaaaacttagagatacagacactgtacttactttttaagaattagagacagtaactccaaaaataattgtccttttttctttctttttttttttttacaataaggctcttgaaaattgtcattacttgtgttttcctatacattcatctgtgtgaaagcctttttcttctttgatttaaaaaaattatacagttaatggtttagaacttagaactacttagaattaatgctaaagtgtcaggaagaaattaatttagcttcaataattgtgactggcctcaggaattctcccttccacacctgcccacctcacctcacctcacctcaccgcaccgcaccgcaccgcaccgcaccagagccagagcagctgcttgtctgcagcaggacacggttcctacatacgtttcagttctttcatggtaagctcaatggactttgaattgtttacagtgctgtatgtccaattgttaaatgtaccattctgaacgatgttaaagcaagtgtggtttatttatggcatgaaccatgtaacttgaaatatgaacttacaaggaggggcactcattaggtaacaagttcttacaccaaacttccttgatgaaataaggccaaaataatcctaaaattcattaggaagaacttggataaaaggactccaaataaatgtttagaaagagcccataattttaggactcctataaaattcttccttgtttgttaatgctatttaattcaacagcaccatgttagaaatatattggcagccaagactctgaactctgcagaaacatttgtttcacccagacttcaaactctagccctgactatgatgcccctgtgtgcatttacaataaagactccaacggagggagcctgttggtgttaaattgtttacatttctttatacaaataatgtgctttcagtgccttagttacagctccctttctgtttcttgttccaaggattctgtagtatgtagagtgttta

SEQ ID NO: 30336 - DNA, 251 bp, Homo sapiens
cacgaagccctctctgccttctgtctgtggatttgctgttttgtacacttcacataaagggaatcatacagtatagaatcatcagcttttaactttttgatagatttgtgttccttctctctgtccctcccttgcgatctcttcccaggtatagacataaacacattttttcctatcctttctcctcctgtttttttccctccatctctcccttcctttcttaccaccccacccctgcctttccattcctg

SEQ ID NO: 30337 - DNA, 335 bp, Homo sapiens
gatgagcgagcatgaaaattagaggtacagaagatataaaagagactctgatttaacttctagagattataaaatgcataggctgtgactgttggcagcttagagattgtaaagatgagtgaagttgaagacagcaacagaaaccattcaaaaggaaacacaaagagaaaaaaatgactgacaaaaaattaacagagcatcagtgagctatggggcaacttggggtcctaaaagggtggagaagcaggagaaatgtttgaagaaatgaggagtgaaaaatttccaaattcgatgaaaactatcaattaaaagatagaaaattttcaaaaaaaata

SEQ ID NO: 30338 - DNA, 542 bp, Homo sapiens
cgagattgtgccactgcactccagcctggcagtagaaccagaccctgtctcaaaaacaaaaaatctgtctaggctgggcatggtggctcacgcttgtaatcccagcactttgggaggctgaggcaagtggatcaccagaggtcaggagtttgagaccaacctggccaacatggtgaaaccccgtctctcctaaaaataaaaaaattagccgggcatggtggtacatgcctataatcccagctacttgggaggctgaggcaggagagtggcttgaacctgagaggcggaggtcgcagtcagcttagattgcaccactgtaaagaaaagaaaaaaaaaagtccatacatgagtgtagggaatactttgtgaatttttagactttttattaaccaccagagaatatttactacacctgggtgttttttaaagaatactgttcttattctgaaataagtagaccgttttgcatatgatcagccagtgtcccttacacaatttatttcatgtaattttcatctttcccatgtaaatctcagttcagc

SEQ ID NO: 30339 - DNA, 280 bp, Homo sapiens
ttttaaaattcctaattgtgttagactcctcttttgaatattttcatgacaccttctacttcttgtttaccacaattagcatgggtataattattaaattactttgtaattacttgtttataattttttaaattacattgaaattatttgttttatctccctctcccctgaaagcatctaaattccttgggtgtaagaaccacatctctgttgctcactagtgcattgctgcataatgtaggtaatggaatatttatggaataaaagaattagttaatag

SEQ ID NO: 30340 - DNA, 446 bp, Homo sapiens
tgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgtttactttggt

SEQ ID NO: 30341 - DNA, 515 bp, Homo sapiens
cgttcaaaacccttgccctttaggaaccgtcagtcagtgttctcagctgcagaatgtaaattaggagtcctaggtattcagaaatgctatagtgaatacacagaaggtctccaaacatggaaatgtacttttggtggttgaaagacatattgtatactagttagagccagagctctggagtcagattgtctggatttgaatcctggcttcacaaatcacttagctatgagaccttgggcaagtcacatattgtctgtaagccttaggtttcttaaaaatctagaaatgatgacaataacagtatttaccttccagagttgttgtgaggattaatacattaaaaatgatactcataaagctcttggcacaagagcttggcacatagtaggtactcagtaaatgttattgattaaaactagctatttttgaaagccttttgaatttctcctcaatcttggtgatgacataatgacccttactggatagagtctttcataaatacacacaaacctaag

SEQ ID NO: 30342 - DNA, 458 bp, Homo sapiens
gttaagggagtatttacctgagactttccttagtgctttacatatattaacctactttaatcctcacaacaacacaatgaggcttatcccatactagataggtgaacaaactaaggctcagagagattggataacttgccccagggtcatatatctagtaagtagtagagctagaatacagagctacaaactaagggtggtgaaatgctgcaaagccagaaaagcactgagaagaaatgaagggaaagccctggccattccatagttcagtgtaatcagtaacttatgatagtttgtattatttaagtagaaagttaaaatgagtcaatttcatgtgatgggctgtgtggctctcttttctccttgtgtgtctctttgtgggtgtgtgtgttgaaggccttttaatgctctaaaacaaaacagattatatctgaccattgttagagaaactttgtaaa

SEQ ID NO: 30343 - DNA, 389 bp, Homo sapiens
atattgcctctgaaaacttccgaagccctcaagcttttacagccaggtcagaataaaccactcctgtgtgttctcctagcacctttgctgcatctcttagtgcagtcagtgaatctagtttgtcttccagttcatactaacctaccttgtgaaaaggaagggtcacataatgaattgtgtactttacagtcttctctaacaaaagtgggagctcttccatagtgggatactgttcaggctctcattcaatcattactgagcacctaccacgtgtcaggcattagctgaactgctgggaattcaggggtgaggcagacccaatccctgccctcactcttacatctcctgtagcctagcccaatgtctagcccagggcctggcacagtagg

SEQ ID NO: 30344 - DNA, 250 bp, Homo sapiens
atcatatcctcttttgtccaatcagacctttgcacaactgacaactcttcatcaaacctaagcataacaatacagtttttactgtttctctgggtcttcatttctgaagtcccctgtgtcctgtaaaacttaaatagatttgtgtgtttttctcttgtaaatgtgtcttttgttacaaggatctcaccatgaatccatcaatgaaagagaaaaaaaaatcagttttctgctatacttctcttatatacac

SEQ ID NO: 30345 - DNA, 835 bp, Homo sapiens
cctggcaacctccaaatagaaaaccattgtgctactggtattacagggtgtggaggattatagatgacttatgtgctatttaagcaatgcattctatcttatcatgtatatatgtgggtatgatgaccaccatactatcggattattgcagagtgtgaggtagtgtgcggtttttaagtgcgtgtgtgtgagagaataaatgcttgaatatctgcaataagtattagagagcactcctgaaatataagccacttcctgacctgggcatattaaccaagaagcaaacctattaaaagtatgagagcattcgattttctacaataatagtacacatttgttgacatgaactagattcaggaagggaatacagaaagagcaggcagacattgggcctatttaattaacttggggcttatgatcacccttcagaagaggatgctaaggatgccttctccagagccaagaggcctctccttgtgcctttatttggctttcctcctctcattggtgacccatcatgttaggaaaaaaaaaaaatctctcaaaagtgtaaatgttattctttctgtgggtgatgtcataattttagtggcccaagcatttgttactaaaatagtacttagcaacacataatcattattttctcctcttaaaattctgagtgtgtttgttctgatgaagtcaggagacacatttttcagggaggtaggagtaagagcttaaaaacacgaagtaatgcctggaataatctcttgacttgtgttccttaaataagcaagaagacaactaaattttccttcctgtggcgacagctctggcggagtaaaaaaaaatt

SEQ ID NO: 30346 - DNA, 272 bp, Homo sapiens
ctgaagccaagacttttatggacacagaaaaagttggttagtcctacagatggaaatttcatctcagtaggattatatagctatttcttttattaataaaaattttctattaagtgtaccagagccacttttcagctctgaggataaggaactttataggtgcctagatgagactctttttattcccctagaaatgttgaaatttttgctctaattaaattagactcaaaatatgaacattccttgaacatataccacttagtcatccagac

SEQ ID NO: 30347 - DNA, 698 bp, Homo sapiens
gtgaatgtgcccatgaaggtcagcagcccagtgactgccagcaccctgccactgccaccactggtgcaagtgtaagcatggacactggcaaccctgctcccacctgcaccctgccacaggtacaagtgcacacaggaatgcagcagctcgacttctgctggtaccccaaccccaccaaggcataagcaccctgcggcgctgccacaggtgccagaacacgtgagtgagcacagatcctgctgccaccgccccaaagaagcactttgtctggcaccacccatcagagggttgtggctaatggaccaggaacaccttggaccctctgatgcagcaggttcccaatctcacggggccagataacaaagctggggtcctggtaccaactccccagacttagagtccaccaggagtgctgagctgagccgtggcccctaaaatcttccagaaatgaacccagtcaactgaacctaccttataccgcaatgaaacccccaagggcagcaaagaagagaaaagcaaagaaaaaaacatgcatcgaaaggacagcaacttcagaggttgagggaacatcatcccacacagataagaaggaatcagcacaagaactctggcaactcaaaatgccagaatgttttcttacctccaaatgaccacacaagttccccagcaatggtccctacctggggctgaaatgacag

SEQ ID NO: 30348 - DNA, 550 bp, Homo sapiens
cctgaatcaccctttagaatcatggattccttgaccattggtaccaggagggagctcagtggtgttgcggcctcccttttgtattactgatggtccagccaagctccagacaggagcagtgtgttggccgcaatggcacagtgagttggcgcagagccagagctagaacccctccactggacttctggttaagggatgtattcttcctcatactatcagcagaaatcaacggcctcatgtctctcctccaaatacaaaaagcactctgaataacaaaaatgatcatttaaaaatgtatccattaggctgggcgtggtggctcacgcctgtaatcccagtactttgggaggctgaagtggttcgatcgcttgagttcaggagttcgagaccagcctggccaatatgaaaccccatctctactaaaaatacaaaaattagccaggcatggtggcgggcgcttgtaattccagctacccaggaggctgaggcaggagaatgacttgaacctgggagacggaggttgcagtgagcggagactgcaccactgcac

SEQ ID NO: 30349 - DNA, 424 bp, Homo sapiens
gtattctgctccacaagctccacgtgtacttattcctcagtacgcccccttagtgagtttgtttattgggtgagtgaaaggaacagatgagtagatgaatgacccaggtgaggcctggggtcggggaggactgtggctcttcttacctgctgttgaagctggcctggtggaggaggctggaggcaaaggtggggacgtagtctctgtagcttctgcaagtagagggtctgctgctggggtcagggaggatctgaacctgggcctgcttgactctacagtctgtttgtttctactactgtctgcgaaggtctgctgtttctactgctacatagtcacctgcatctaggtcttctttttgccattgttgggaattggcataagatggaatgagattagatggcatcatggtcagagtgacccattt

SEQ ID NO: 30350 - DNA, 377 bp, Homo sapiens
catttggacctgcagttaagcccaaattaagaaagttacacagcataatcgaataagaaaccatatgaatactgaagtctcttatctgatcattgctgcagctatcattaaaggtcatacccattatctagcagagattcaaaaggtaaatattaggaagaaatgataaatcactacttctatttggagcaggaagtacagggatggagagtagaaagccgtaatgttggagaatacagtggcataggaaaacattaaataatcaaagattaagttattgataataaacattcctaaacaaaaattagtcctgtagcatgctggtcattgtagtacaataattacatcaactacgtcctctcaaactagccatactc

SEQ ID NO: 30351 - DNA, 1378 bp, Homo sapiens
  misc_feature (27)..(27): n is a, c, g, or t
  misc_feature (1102)..(1102): n is a, c, g, or t
ggaaggtggcagagcagcctccccaantaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgttggagtagatactggtcctgtgattggtggactggggaacacacgtgttgggtgcttctgggtagccctggtttgcattagtttatgtttccatgccagagtttgtgtgggcgggcgcatgtgcaccacagagtgcactngaggggactatcagtcaccggattccataatgtcatgtcacactttcaatttgtacattagtgaatttttatattaaaggtgagcaagccaggtgttttgaagcagtcatttagggtaggatggatgaatgggtggagttgaacgtaaccttatagaaggaaaggggggaggataataaaatgtgtgaaaaaagggggtatcagggggagacaattaagaaaagaataggggaaagaaggtggaagggggaaaaaattgtggtttatgtcgtgtag

SEQ ID NO: 30352 - DNA, 1514 bp, Homo sapiens
  misc_feature (27)..(27): n is a, c, g, or t
  misc_feature (1238)..(1238): n is a, c, g, or t
ggaaggtggcagagcagcctccccaantaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcaggtacaatgagagaaatgcaaagatagttaagaaagactcggccttcaaggagcctaaatgtgtagaaaaggactaaggcaaaacaataacttttttgagctcttgccatgtgtgaagcactttatacacctgtaagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgttggagtagatactggtcctgtgattggtggactggggaacacacgtgttgggtgcttctgggtagccctggtttgcattagtttatgtttccatgccagagtttgtgtgggcgggcgcatgtgcaccacagagtgcactngaggggactatcagtcaccggattccataatgtcatgtcacactttcaatttgtacattagtgaatttttatattaaaggtgagcaagccaggtgttttgaagcagtcatttagggtaggatggatgaatgggtggagttgaacgtaaccttatagaaggaaaggggggaggataataaaatgtgtgaaaaaagggggtatcagggggagacaattaagaaaagaataggggaaagaaggtggaagggggaaaaaattgtggtttatgtcgtgtag

SEQ ID NO: 30353 - DNA, 1324 bp, Homo sapiens
  misc_feature (27)..(27): n is a, c, g, or t
  misc_feature (1048)..(1048): n is a, c, g, or t
ggaaggtggcagagcagcctccccaantaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaagatcctcatgaatgactatcctaaatttaagtatgcagttctctttttgctgggtttattcgtgctggttcatcgtgagtaagaagcctgccttgctgttcctgggaagatgccatagttttcgttactggatgttggagtagatactggtcctgtgattggtggactggggaacacacgtgttgggtgcttctgggtagccctggtttgcattagtttatgtttccatgccagagtttgtgtgggcgggcgcatgtgcaccacagagtgcactngaggggactatcagtcaccggattccataatgtcatgtcacactttcaatttgtacattagtgaatttttatattaaaggtgagcaagccaggtgttttgaagcagtcatttagggtaggatggatgaatgggtggagttgaacgtaaccttatagaaggaaaggggggaggataataaaatgtgtgaaaaaagggggtatcagggggagacaattaagaaaagaataggggaaagaaggtggaagggggaaaaaattgtggtttatgtcgtgtag

SEQ ID NO: 30354 - DNA, 1056 bp, Homo sapiens
  misc_feature (780)..(780): n is a, c, g, or t
actactactaattcgcggcgctcgacgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagcaaaatgggcatatcaagtttttgaccaaaggagataataatgcggttgatgaccgaggcctctataaacaaggacaacattggctagagaaaaaagatgttgtggggagagccaggggatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgttggagtagatactggtcctgtgattggtggactggggaacacacgtgttgggtgcttctgggtagccctggtttgcattagtttatgtttccatgccagagtttgtgtgggcgggcgcatgtgcaccacagagtgcactngaggggactatcagtcaccggattccataatgtcatgtcacactttcaatttgtacattagtgaatttttatattaaaggtgagcaagccaggtgttttgaagcagtcatttagggtaggatggatgaatgggtggagttgaacgtaaccttatagaaggaaaggggggaggataataaaatgtgtgaaaaaagggggtatcagggggagacaattaagaaaagaataggggaaagaaggtggaagggggaaaaaattgtggtttatgtcgtgtag

SEQ ID NO: 30355 - DNA, 1259 bp, Homo sapiens
  misc_feature (27)..(27): n is a, c, g, or t
  misc_feature (983)..(983): n is a, c, g, or t
ggaaggtggcagagcagcctccccaantaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagatttgttccttatattggaattgtgacgatcctcatgaatgactatcctaaatttaagtatgcagttctctttttgctgggtttattcgtgctggttcatcgtgagtaagaagcctgccttgctgttcctgggaagatgccatagttttcgttactggatgttggagtagatactggtcctgtgattggtggactggggaacacacgtgttgggtgcttctgggtagccctggtttgcattagtttatgtttccatgccagagtttgtgtgggcgggcgcatgtgcaccacagagtgcactngaggggactatcagtcaccggattccataatgtcatgtcacactttcaatttgtacattagtgaatttttatattaaaggtgagcaagccaggtgttttgaagcagtcatttagggtaggatggatgaatgggtggagttgaacgtaaccttatagaaggaaaggggggaggataataaaatgtgtgaaaaaagggggtatcagggggagacaattaagaaaagaataggggaaagaaggtggaagggggaaaaaattgtggtttatgtcgtgtag

SEQ ID NO: 30356 - DNA, 707 bp, Homo sapiens
  misc_feature (27)..(27): n is a, c, g, or t
  misc_feature (707)..(707): n is a, c, g, or t
ggaaggtggcagagcagcctccccaantaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcagctctattatcaagtcctaaattttggaatgattgtctcatcggcactaatgatctggaaggggttaatggtaataactggaagtgaaagtccgattgtagtggtgctcagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaaggcgaggcctctatcaaggaccttggn

SEQ ID NO: 30357 - DNA, 594 bp, Homo sapiens
  misc_feature (500)..(500): n is a, c, g, or t
  misc_feature (502)..(502): n is a, c, g, or t
  misc_feature (505)..(505): n is a, c, g, or t
  misc_feature (507)..(507): n is a, c, g, or t
  misc_feature (509)..(509): n is a, c, g, or t
  misc_feature (511)..(511): n is a, c, g, or t
ctctattatcaagtcctaaattttggaatgattgtctcatcggcactaatgatctggaaggggttaatggtaataactggaagtgaaagtccgattgtagtggtgctcaggtaacagtttttcctttcaaggcatggaattgcatggcattacttgggagaaaaattgagatatgaaataactggcatatcattctcttagaaactactcttttccagaaaagggcctggaagaaaattagtcactacttatcagttgtaagaaattctcaggctgggcacggtggcttatgcctgtaatcccaccaatttgggatgctgaggccggtggattacttgagctatggaatttgagactagcttgggcaacgtggtgaaaccctgtctccacaaaaaatacaaaaattagcgggtgtggtggcatggacctgtagtctcagctactcgggaggctgaggtgggaggatcacctaagccctagaggttgaggcctgcagtgangnttngntngnattgcaccactgcacttcagcctgggtgacagagcgagaccctgtctccaaaaaaaaaaaaaaaaagagagaaaagaaattct

SEQ ID NO: 30358 - DNA, 933 bp, Homo sapiens
ccacacaaatgagagatttttatgtatgtggtcccactatcaaaataataggaagcagttaatggggctttgagaaaagcatagtcccgtgtacagtaatatgcatctaaatagagttttccattcacctgtcaattattttcacaagattagcattaaaaaatacaagcaaacatatgacccttaagcttcacacacaaaaaattggtctttgttcattctcagatgacaggatgtcccaaaagtaacaaaagatgggagccagtcctctcatagctgtttcttcaatcatcccatcaacagctcttcatttattgaactaccttccttttccaaagaggtaatgctgagatcagtcagaaaggctttctgagaaaactggcttggatttctgggtctgttgcagtcaattcaagatgaactggcttgtatcaatgaagcgctcaatgcagttcacaaaacaggcctcagcccgactgtccaactttggcccaggcttgtccatgcacttctcccaacaaagttcagtcatctggtgcaccagctgctggaagcgctgcttttgagtctctacctcaatgaaaatgctgcaactgcgggtccactgcacccaaacccgccgcagaggaagagcaggaggaatccatcccaggacaaccatgcttgcagagacgaactccgcaccaaccttcacgtgtctccacgacctagttaatcaatttaaaatgaggtcactagggtgggccccaatccaatatgactgataactttataaaaaggagagatttggatacagaaagagacagagtgaaaaccatgtgaagaaacataggaaaagatggcagctacaagccaaggagaagcttgcagtgtgtattcatctgttctcatgctgttaataaagacatacctgagactgggtaatttaaaaaa

SEQ ID NO: 30359 - DNA, 146 bp, Homo sapiens
atgttgcaaaatgaaataatatatatttgctattatgaattatagtgtcactgtgatagagccaaaatttgaacccagagatggcgtgtgtctctgcccacactactgatcatctgcaattccccatctattattgaaaaaaaaaa

SEQ ID NO: 30360 - DNA, 109 bp, Homo sapiens
atcactacaagaaaaagcagtcttaatttttatttattagaaaaggttttattatattatttatgtaaataatgataaatacaacatttaaactataacatatttgata

SEQ ID NO: 30361 - DNA, 455 bp, Homo sapiens
ctcaggaaataaagaatgttctaatggttgagtttataagatagatccatttctatctctgtccttagagagcccttatcttgttgcctgccctctcctaggaggcattgttgacctttaccattgtaggcactgaaccacgctgaaagagaagccttacaggatggaggcaacttttatccaaattgaaaatgtttttataaacatacattagctcttcatgaaccatttgtttcctgaagtcccaatggaaatgatcatattctgttagggattccaatgatatattctttaaactaagactcgtgaacgttaaaaggcaaaagcgaagccagaagtaaattttgactcattctttatataatcatttgaaaacttcacttgaaaactggagaaaattttggaactttcttgttctactatggagaagataaaagcagaagcatccacagtat

SEQ ID NO: 30362 - DNA, 740 bp, Homo sapiens
agaaatgggattatgctatgtgcccaggctgctctcgatctcttgtactcaagtgattctcctgcctcggcctcccaaagtactgggattatacatgtgagtcactgtgcctggcccccaacccctttaaagaacatcctccagtacccatttgacctggggtctttccaagcaagaggctggcatgctgccctccaggcctcccacccattccccgccgtgccttcccacccatctcatctcaccagcagattcaattagctgatttgatgctacagctgcagaaagccaagcaattatggaacacagaccaggtgccttggcactcgctctcacagaggggtctgggaggcctccagacagacagcagggcgagagggaggtggaacagtagaggcaaagattggccaacccagcctgcacaagagagccacctgggagctttgaagaatacagatgccttccaaaaccccaaaaaacccagacgcctgggttgattcagtttatctgttctgggaacggggcatcagagtttttttaaagtccctgagtaatactaacgtacagacagggttagggagtcaaacaatgtgcaggggtagggaccagtgctagagagtttgtttgtttgtttgtttgtttgtttatgtttttgagatagggactggctctgtcacctagactggagtgcagtgccgtgatctcgggtcactgcaacctccacctcccaaggctcaagc

SEQ ID NO: 30363 - DNA, 1043 bp, Homo sapiens
  misc_feature (15)..(15): n is a, c, g, or t
  misc_feature (35)..(35): n is a, c, g, or t
  misc_feature (45)..(45): n is a, c, g, or t
  misc_feature (859)..(860): n is a, c, g, or t
  misc_feature (864)..(864): n is a, c, g, or t
  misc_feature (870)..(870): n is a, c, g, or t
  misc_feature (1042)..(1042): n is a, c, g, or t
ttacggggtctaagngtagcgatggcccctggcgntgggtataantcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaaagggacctgaaaagctgattggggtcctgaagttatgcggggatgttccgcacgcacggaagggaggcaggtnngganagaccntttaagaccctttacggttgggtgagtggactcgggctctcggaggggggagggtgggcccgcgctgcgttgagaggacaggcctgtggggggccccatgcccctgtgttaggggggtggcattgtccgcggggcgtcaggtggggtctaaacgggtggctcctccgtcggna

SEQ ID NO: 30364 - DNA, 1052 bp, Homo sapiens
  misc_feature (39)..(39): n is a, c, g, or t
  misc_feature (920)..(920): n is a, c, g, or t
  misc_feature (930)..(930): n is a, c, g, or t
  misc_feature (935)..(935): n is a, c, g, or t
  misc_feature (947)..(947): n is a, c, g, or t
  misc_feature (955)..(955): n is a, c, g, or t
  misc_feature (959)..(959): n is a, c, g, or t
  misc_feature (961)..(962): n is a, c, g, or t
  misc_feature (966)..(966): n is a, c, g, or t
aagggagaagggggccaactataggctaggtacgaggcngggtgttgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggggcaagatgcggacgagacctttttcaaagagaccctctaaagtgggtganggaatccggncttcngggggagggtgngcgcgctnactnannaaangcggggggggccacgggcctggtcaaggggtgcgaatgtccggggagccccaagggggcgcaatgaggcgctgctctcctctgcga

SEQ ID NO: 30365 - DNA, 2541 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataaaaaaaaaaaaaaaaagaaaaaagtttgtgcggggcgggccggaaaagcttttacccctctttggggccgggcccctggtaggaccctggccaaccggtccgggggaccggggcggactggtctggtttcccccataaaacccgggcccggctttggacatcgggggcgggctcgggctccggtcacggctaccccccggggggg

SEQ ID NO: 30366 - DNA, 2315 bp, Homo sapiens
  misc_feature (33)..(33): n is a, c, g, or t
  misc_feature (2263)..(2263): n is a, c, g, or t
  misc_feature (2281)..(2281): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaaggaaatagggntcccataatttgggtttnaacttgaattggtggttaataattggttgccaaa

SEQ ID NO: 30367 - DNA, 2343 bp, Homo sapiens
  misc_feature (33)..(33): n is a, c, g, or t
  misc_feature (2292)..(2292): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccagaaactagggctcctactaacttatgaggttttatacacantacccggatacataaatatgagtaggtgggcttggggtgggggtggagagg

SEQ ID NO: 30368 - DNA, 2158 bp, Homo sapiens
  misc_feature (33)..(33): n is a, c, g, or t
  misc_feature (1983)..(1983): n is a, c, g, or t
  misc_feature (1987)..(1987): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttcttccattttcacaaagctgtaagaataatncatntaacttaacttttctctggagcaggggggtttccccggcgccacttcacaaaactggcggaaagcacacgggttgtgccggtgagatatgggggtccgcctggagaataacgaacacaggtgttggctgggacaacccggtttcacaacacgtaggttgggggggcaaaga

SEQ ID NO: 30369 - DNA, 2684 bp, Homo sapiens
tccccccccccccccccccccgcgccccatcatcggctaggtacgaggctgggtggtgcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagtgagtgcggcctcgggggtcggggaatcaggctgatagggaaaggtaacaggctggcccggaaggggctggagcggaggggtcatgcggactgagctactgaggggcccgcaccggtccgctgggcacggcgtggtgggaagacccggtgtcgcgcctgggacctgagcgggcaggcccaggctgaagtctatggaggtgcgggtcggcgaccaggatgagcgcagagaggggaccctggcaggctccgacccgaggccgtttgttaggaggggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataa

SEQ ID NO: 30370 - DNA, 1908 bp, Homo sapiens
  misc_feature (33)..(33): n is a, c, g, or t
  misc_feature (1589)..(1589): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaaaaaaanaaagacaccaacaaaaaaaaaacaaaaagcacaaacaaaaacacaaagggcgcgacacccaaaagatacccccaagagagggcgacaaaggaaacgcagaaccacagagaagagaaaaaaagggacgcccaaaaaagagggcagcacaaacacaacgccacgacagccagcagcacgcaacaaccacaccgacacccgggggcaaaacacggcacgcggagcacaacacgatgagaggacaccctacacaccaggggggggggacacaaaggaggacacacataccacaaacgcactcaacgaaccaagcgggcaaaga

SEQ ID NO: 30371 - DNA, 1996 bp, Homo sapiens
  misc_feature (33)..(33): n is a, c, g, or t
  misc_feature (1598)..(1598): n is a, c, g, or t
  misc_feature (1996)..(1996): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaacacaaaaacaaacancacacacaagcaagcaacacacaatcacagtaacaacacaccacaccacaacacacaagaaacaaatacaaaacaaagcacgcagcggcgcaccaaaaaagcaaccacagggaccacgagaacagaacacacacgacagaacaacgcgcggccaccaacagaggcaaggaaaaaccaaccacgagggcaggagaacaccccacaatgcacccaacacccacagatcaccagcgacagcaaacctgcgtgagcaagaagacaccagcaaagcaaaacgaccgagcaaacacatgagacgaagaaagcagaagccagggaataacacaaccaaacaccaccaccaagcacacacaaacaaagcacacacgaagagaccaaagaacaaacacaggagcagn

SEQ ID NO: 30372 - DNA, 1893 bp, Homo sapiens
cctctactagtgaactctaaaccaactggcttaaatcgccagcccatatccttcacagtagtggctgtggttgatgtagctcagggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataa

SEQ ID NO: 30373 - DNA, 2203 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaatgggacccaagtaacagggaggaaagcagatgttattaaggcagctcacctttgtgctgaagctgccctacgcctggtcaaacctggaaatcaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataa

SEQ ID NO: 30374 - DNA, 2731 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaaggtactaagcaatgatagtacttggaaccagtctgactcacagaccatacacccaggaacactttttcctctcccttcctgcctagacttgtagcgtgcatgtgctcactccctccctctctctccccatctccttctcattgaaggtaatgtaaaagagcaatcctaagcatgatttctgcctgagggtaggagctattttaaaatatgagcaaaatggtaagacttgatggggagttaaagatacctctgaatatcatcttccctgccagagcatttgaagatgagaagaaggctcggatgggtgtggtggagtgcgccaaacatgaactgctgcaaccatttaatgttctctatgagaaggagggtgagttccaaaaagagcttcactttggattccctgattataagatatccttcctgtaagttcagaagagctaagtatgacaaaggaactttttatcaaaacacatcttcatttttgccataggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataa

SEQ ID NO: 30375 - DNA, 1527 bp, Homo sapiens
cggacgcgtgggtcgacccacgcgtcggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataa

SEQ ID NO: 30376 - DNA, 2053 bp, Homo sapiens
  misc_feature (33)..(33): n is a, c, g, or t
  misc_feature (891)..(891): n is a, c, g, or t
  misc_feature (897)..(897): n is a, c, g, or t
  misc_feature (1655)..(1655): n is a, c, g, or t
  misc_feature (2053)..(2053): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaagccaaggatgcaggacagagaaccactatttacaaacgagacccctctanacagtntggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaacacaaaaacaaacancacacacaagcaagcaacacacaatcacagtaacaacacaccacaccacaacacacaagaaacaaatacaaaacaaagcacgcagcggcgcaccaaaaaagcaaccacagggaccacgagaacagaacacacacgacagaacaacgcgcggccaccaacagaggcaaggaaaaaccaaccacgagggcaggagaacaccccacaatgcacccaacacccacagatcaccagcgacagcaaacctgcgtgagcaagaagacaccagcaaagcaaaacgaccgagcaaacacatgagacgaagaaagcagaagccagggaataacacaaccaaacaccaccaccaagcacacacaaacaaagcacacacgaagagaccaaagaacaaacacaggagcagn

SEQ ID NO: 30377 - DNA, 1187 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagtaggtgccaaccctacttattaccttctaccacacaagactagtcatcaggtttttttctatactcccaactgaatcttgtccgccctctactccatgttttcaggagtgacctgttgctcttaatattccctttctctaggccgggcgcggtggctcacgcctgtaatcccagcactttgggaggctgaggcgggtggatcacctgaggtcacgagttcagaaccagcctaaccaacatggcgaaaccctgtctctactaaaaactacaaaaatgagccaggcctggtggtttgtgcctatagtcccagctacttgggaggctgaggcaggagagttgcttggacccgggaggtggaggttgcagtgagctgagattgtgccactgcactccagcctgggtgacagaatgagactctgtgtc

SEQ ID NO: 30378 - DNA, 753 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaagatgtgtcacaccagttgaagcggctgtctccatacccattacaatctccagcattccccctcaaaccta

SEQ ID NO: 30379 - DNA, 1072 bp, Homo sapiens
tccccccccccccccccccccgcgccccatcatcggctaggtacgaggctgggtggtgcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagtgagtgcggcctcgggggtcggggaatcaggctgatagggaaaggtaacaggctggcccggaaggggctggagcggaggggtcatgcggactgagctactgaggggcccgcaccggtccgctgggcacggcgtggtgggaagacccggtgtcgcgcctgggacctgagcgggcaggcccaggctgaagtctatggaggtgcgggtcggcgaccaggatgagcgcagagaggggaccctggcaggctccgacccgaggccgtttgttaggaggcaagacgtgttttctcttgttcctatccttcattcccgattattgcttcctctgattctggcagcggcgaggccacctcgaaaaggaagcgcccagctattggcgacagaagtgcccctctgtttttgtagcgtctccggggcgtcaggagccaagccggcacgtgttgctgggtcccattgcggatggctggcccccttcttactccgctagtgtccctgacaccagcttccccaccaccagcttccccaccacgtgctttgctggagcctttccttctttacttcagctcttaccctggtgggggcccccttctaccttgggccagctaaggagaccgttggagagcactcctggagcttctaatgcaagtcttggagatatatatggcttttcttgaagttactcattactaccacctttccaatctgtgcagatagtcttagttagcattcacatttgttgttctcagtgacttgacaactcaaatgttttggggtct

SEQ ID NO: 30380 - DNA, 926 bp, Homo sapiens
  misc_feature (774)..(775): n is a, c, g, or t
  misc_feature (778)..(778): n is a, c, g, or t
  misc_feature (783)..(783): n is a, c, g, or t
  misc_feature (790)..(790): n is a, c, g, or t
gctacgcctggtcaacctggaaatcagaacagggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaagctccagatggagaatgnnccnggggnacattgnagaatgcaactgggctgggggtccatctccaggttgtgttcgactatccttcacaaaccaaattggaaggcgttttcccctagaggcccaaggggttcgggccccatcccactttcaaaacacggctgcggggcca

SEQ ID NO: 30381 - DNA, 2337 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataa

SEQ ID NO: 30382 - DNA, 2410 bp, Homo sapiens
  misc_feature (33)..(33): n is a, c, g, or t
  misc_feature (2278)..(2278): n is a, c, g, or t
  misc_feature (2283)..(2283): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccagaaactaggggtccactactttgggtnttaanccccttacatggcttgcttacatacaattggttgtcctactggaaacaaaagagggggcaaatacccaggggccgatccacccactctggaagggccacaaggattaaaaaagggggcaacaggaag

SEQ ID NO: 30383 - DNA, 1583 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaa

SEQ ID NO: 30384 - DNA, 2283 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataa

SEQ ID NO: 30385 - DNA, 1668 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaaaaaaaaaagataaaacgccaaaaggcccaaaatatgaggtacagcccaggaaaacaaggtaaagtctcacgagacaaaaacccgg

SEQ ID NO: 30386 - DNA, 2503 bp, Homo sapiens
tccccccccccccccccccccgcgccccatcatcggctaggtacgaggctgggtggtgcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaatgtaaggttaaaccgttttaaagcatttttctttttttaaagcatttacaaaatgccagttcctaatgcagtactctgatcttgcctttcagtgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataa

SEQ ID NO: 30387 - DNA, 2273 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataa

SEQ ID NO: 30388 - DNA, 2419 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggtgaggagagtaccagagttggcaaagaggggtgactgagagtgttcaccagaccaaatgttacttaaattactctttcagggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataa

SEQ ID NO: 30389 - DNA, 1273 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggctctcagagttggagtgaaaaccgaaaaaaaaaagggggcaacgggatgcctggacataaaaaaagggggggg

SEQ ID NO: 30390 - DNA, 2152 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaagtgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataa

SEQ ID NO: 30391 - DNA, 1723 bp, Homo sapiens
aattcggaacgaggcagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataa

SEQ ID NO: 30392 - DNA, 1026 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaagacaagaatgcaggacagagaaccacaaataactgaccgagacatcttctagactatcatggaacttataatgtacagtacaattgctttcataactgaggtgtataaaggatattgatcctcagaccttgtactttaagagcactcaatagatatgagaagaaagggtcgaaatgggtgtgcgg

SEQ ID NO: 30393 - DNA, 1288 bp, Homo sapiens
  misc_feature (33)..(33): n is a, c, g, or t
ccccatcagtacacctacagaaacgcgaactcncgaccggcggaacctccgtagaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagtaagctattttatccaattccaaagctcgtttgaaccaaagatgcattaggcacctatagctactctatatgaaactaccaacctcccctacagaccccttataaaacagctttttaaaattagctatatttagctgggcacagtgactcacatctgtaatcccatcactttggggggccaaggtaggaggatagcttgaggctgggagttcaagaccagcctgggaaacatggtgaaaccccatttctacaaaaaatacaaaaattagctgggcgtggtaacatgtgcctgtattcccagcttccagggaggctgaggtgggagaatcacctgagcctgggagattgaggctgtgctgagctatgatcatgccactgcactccagcctgggcaacaatgaaaccctgtctcacaaaagaaaaaggaaaaataagcatttgctgtccccacaaaacagattagaatgccaggtaaaaaaggataaacactggacttaatattataggcatgtggtggcacatgcctgtaatcccagcactttgggaggccaaggtgggaggattgcttgaacccaggcatttgagaccagcttgggaaacatagcgagacccgtctacaaaaagaaaaaagaaaacccaggtttatgaccaagttctttcacttaaca

SEQ ID NO: 30394 - DNA, 693 bp, Homo sapiens
  misc_feature (683)..(683): n is a, c, g, or t
ctttcaccaacagattaaaaataacagacgaaagagaagaggaaaactggtaaaagcaagcatggtttaccataacaagcaataatgaacaacttggtatcaaagaagaaaaacttaaaaacagagtttaatctggtatcatttagagtgggacacacaggctctgaggactaactgtgaatagtaattgtggttttaaaaaatgaccttgtatcatcaatgaaatctaccctatattctgtttgatttggttaagaaggcagaaattagtattgctctgttcgagaagccttcaaaatgggatggcacttagaggcaaaaatttggtttatttgaaacattcagttttagcaaaaaacattcagtaagcgttgttactgtttaagacaagatctttttcagcaagaaaacagttctaaacaagcttttcagccaaaccaattggccatattgtatatacaactgatgatccatggtcctctgcagctagaactactatgtagtgtacatttatactcatcaccacaaataagttagcaaatatttttctttggtaaaaaaaaaaatttctgtctgggcacggtggctcacacctgtaatcccagcactttgggaggccaaggcaggtggatcacttcaggccaggagttgaagaccaacgtggccaacatagcaaaaccccnatctttacaa

SEQ ID NO: 30395 - DNA, 467 bp, Homo sapiens
taaaaatacaaaaaattagccgggtatggtggtgcgtgcctgtaatcccagctactcaggaggctgaggcaggagaatcgcttgatgcagttaagcgagatcgtgccattgcactccagctggggtgacagagtgaggctccatctcaaaaaaaaaaaagaaaaaaaaaaagaaagagatgtgtttaccataacttactaagaaagactaattaggtgtcattgaaaaggatgctaggccaggcgtgatggctcatgcctgtaattctaacactttggtagaccaaggcaggaggatattttgagcccaggagttcaaaaccagcgtgggcaacatagggagaccccgcctctacaagtaataaaaaaaaattagccaggcatggtagtgcatgtctatggttccagctactctggaggctgaggtggaaggattgcttgagcctgggaagtcaagactgcagtgag

SEQ ID NO: 30396 - DNA, 327 bp, Homo sapiens
tgttcaaatcgctgctgtgtttgaaacaaaatgtcagctggtgttaggtaagaattgctaacttctaaagaatagtgtcatttatagaaccactgcaggggttagaacacagaggatgaccagaaaacacctccaagaagaaagagattgagtgagacttttttgattgcttttgtactcccgagttcctggcacaggcctggcacaagatgggaacttgtctagtgaattaatgaagccatttctaccgttgcctctagggtacctctaagtacgttatattctttgtgggtgttgtttttctgttctgttttttgtttttgtttt

SEQ ID NO: 30397 - DNA, 438 bp, Homo sapiens
acaagtcatattaagctaacttcatgcttactttgccaaagatgtaatagtatttgtatgatactctttgtatagtactactttataacttacagagtacattcccatttattattttatttaaccctgacaacatccctttcaattcgtgtaagatgagaaagacctcaacagtaataatcccaggaaggcgcaaaggggacagatgtgagagattttagaaaggccttgtgtagttatggataaaggagagggaggaatcaaagcaggctttaaggattctagattgtctgagggtgaatggggatgcagataattactcgtaatttaaaaaatacgggtggaggagtggatttggagatgtgaaatccatcagttttcttcagtttggtggaattagctgttttatttcctttgttgaaactgagtcagatatag

SEQ ID NO: 30398 - DNA, 3536 bp, Homo sapiens
atggggacgacggccccagggcccattcacctgctggagctatgtgaccagaagctcatggagtttctctgcaacatggataataaggacttggtgtggcttgaggagatccaagaggaggccgagcgcatgttcaccagagaattcagcaaagagccagagctgatgcccaaaacaccttctcagaagaaccgacggaagaagagacggatttcttatgttcaggatgaaaacagagatcccatcaggagaaggttatcccgcagaaagtctcggagcagccagctgagctcccgacgcctccgcagcaaggacagtgtagagaagctggctacagtggtcggggagaacggctccgttctgcggcgtgtgacccgtgctgcggctgcagctgccgcggctaccatggcattggctgcaccttcttcacccacccctgagtctcccacgatgctgactaagaagcccgaggataaccacacccagtgccagctggtgcctgtggtggagatcggcatcagtgagcgccagaatgctgagcagcatgtcacccagctcatgtccaccgagcctctgccccgcactctgtccccgactccagcttcagccacagctccaacctcccagggcatcccgacatcagatgaggaatcaacacctaagaagtcgaaggccaggatactggagtccatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtcacagttacctggagaggctcctgaatgttgaggtgccccagaaagttggttctgagcagaaggaaccccccgaggaggctgagcctgtggcggcagctgagccagaggtccctgagaacaacggaaataactcgtggccccacaatgacacggagattgccaacagcacacccaacccgaagcctgcagccagcagcccggaaacaccctctgcagggcagcaagaggccaagacggaccaagcagatggacccagagagccaccgcagagtgccaggaggaagcgcagctacaagcaggccgtgagtgagctggacgaggagcagcacctggaggatgaggagctgcagccccccaggagcaagaccccttcctcaccctgcccagccagcaaggtggtacggcccctccggacctttctgcacacagtgcagaggaaccagatgctcatgacccctacctcagccccacgcagcgtcatgaagtcctttattaagcgcaacactcccctgcgcatggaccccaaggagaaggagcggcagcgcctggagaatctgcggcggaaggaggaggccgagcagctgcgcaggcagaaggtggaggaggacaagcggcggcggctggaggaggtgaagctgaagcgtgaggaacgcctccgcaaggtgctgcaggcccgcgagcgggtggagcagatgaaggaggagaagaagaagcagattgagcagaagtttgctcagatcgacgagaagactgagaaggccaaggaggagcggctggcagaggagaaggccaagaaaaaggcggcggccaagaagatggaggaggtggaagcacgcaggaagcaggaagaggatgcacgtaggctcaggtggctgcagcaggaggaggaagagcggcggcaccaagagctgctgcagaagaagaaggaagaggagcaggagcggctgcggaaggcggccgaggctaagcggctggcagagcagcgggagcaggagcggcgggagcaggagcggcgggagcaggagcggcgcgagcaggagcggcgcgagcaggagcggcgggagcaggagcggcgcgagcaggagcgacagctggcagagcaggagcgtcggcgggagcaggagcggctccaagccgagagggagctgcaggagcgggagaaggccctgcggctgcagaaggagcagctgcagagggaactggaggagaagaagaagaaggaagagcagcagcgtctggctgagcggcagctgcaggaggagcaagagaagaaagccaaggaggcagcaggggccagcaaggccctgaatgtgactgtggacgtgcagtctccagcttgtacctcatctcccatcactccgcaagggcacaaggcccctccccagatcaacccccacaactacgggatggatctgaatagcgacgactccaccgatgatgaggcccatccccggaagcccatccccacctgggcccgaggcaccccgctcagccaggctatcattcaccagtactaccagccaccgaaccttctggagctctttggaaccattctcccactggacttggaggatatcttcaagaagagcaagccccgctatcacaagcgcaccagctctgctgtctggaactcaccgcccctgcagggcgccagggtccccagcagcctggcctacagcctgaagaagcactgaggctggcctgcggccttcttggcagcctcgcctcctgtccatgtctatctgtctgtctgtcggtctgtgtcttggtctgttgccctccttcttggcatgccattgtggagggcttggccaggtgtatataaacgtcctctgtgctgggtgtttctgctgcaggtggcaggtggccccaggcctgtttggaggatgggctgggtgggtgggtggggaagaaatgggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgggaaagacctgggtcttgacacggccctgccacttagtcccctaccctctccattccccaggctccacccgtgctgctcaagtgcaaatggacttgagagtatttatgtgctggtgaagtatgaggtctgagtagaaaagg

SEQ ID NO: 30399 - DNA, 1577 bp, Homo sapiens
atggggacgacggccccagggcccattcacctgctggagctatgtgaccagaagctcatggagtttctctgcaacatggataataaggacttggtgtggcttgaggagatccaagaggaggccgagcgcatgttcaccagagaattcagcaaagagccagagctgatgcccaaaacaccttctcagaagaaccgacggaagaagagacggatttcttatgttcaggatgaaaacagagatcccatcaggagaaggttatcccgcagaaagtctcggagcagccagctgagctcccgacgcctccgcagcaaggacagtgtagagaagctggctacagtggtcggggagaacggctccgttctgcggcgtgtgacccgtgctgcggctgcagctgccgcggctaccatggcattggctgcaccttcttcacccacccctgagtctcccacgatgctgactaagaagcccgaggataaccacacccagtgccagctggtgcctgtggtggagatcggcatcagtgagcgccagaatgctgagcagcatgtcacccagctcatgtccaccgagcctctgccccgcactctgtccccgactccagcttcagccacagctccaacctcccagggcatcccgacatcagatgaggaatcaacacctaagaagtcgaaggccaggatactggagtccatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtcacagttacctggagaggctcctgaatgttgaggtgccccagaaagttggttctgagcagaaggaaccccccgaggaggctgagcctgtggcggcagctgagccagaggtccctgagaacaacggaaataactcgtggccccacaatgacacggagattgccaacagcaggaagctgcagcgggagctggatgaggccacggagagcaacgaggccatgggccgcgaggtgaacgcactcaagagcaagctcaggcgaggcaacgagacctctttcgctccttctagaaggtctggaggacatagaattattactaatgcagatgcttctgaggagcacacgtacactcgagacgcagacttcactggttccaagtccagttcattatcaacatttttacaaatttgcaccacaacaaatttatcctactactctacccaccactggctatgactcagcgacgaccccagagcactctccttcttcccagtcaccggtaccgactcgaattt

SEQ ID NO: 30400 - DNA, 745 bp, Homo sapiens
atagtcggctactctggaggctgaggcaggaagatccttagagcccaagaaattgaggccgtagtaagctgtgattacaccactgcactccagcctggacaacagagcgagaccttgtctcaaatgagaaaaaaacaaaaagaaatgggagaatccagagagactaggctagatcaagcctgctgggtcctggcaggagccccagggagtagctcatctgcagacatttgcttgaggactaccccctaaacataaaggaagaatgacatccaaagggtgtggagcagccatgagctgagaactagcctggtctacctgagattgatggcaggtcctggtcaacacgtcagctctgcgtcagagtccatgcctcaagcccaagctgaagccccatccctgctgctctcccaagaactcctctgctagggcaggccccttgcccttgggtgccaggtgggacctgcctgatgggatggggtgcttggcatatacaacttgccatgaactcaaggtgaccctgggggcctcctgaattgtgatggggcctagaaccaatgtgctctgatgtgaccatattctgtgacattaccttgccctgtttactccaaagttcccagcctggtgcccagcaggcaatattgcacctacagacacatttactttggtttccaaagtgtttttagacatttgaatttgttgccaacatttaaacattgagagatttcatatttttaaaaatctggaa

SEQ ID NO: 30401 - DNA, 390 bp, Homo sapiens
ttcatacttggctcaaagccactattgtttggaaaaggtataactgccctgctgacgctgtacagatgttcttgggctcggatgggcatggctccacgtggtgtgcactagcacccagagagagtgaagctattgacccctgtaagggagagtgaccatctggcagatagatagaggggagccaggacatggctcagcttgtgcccagagggagagttaagccgctgaccctgtagccagggagtgcacctgcaagcatgggggtggcaggagccacagagctggctgctgagaggagctgcagatctggagaagacagcctaggtaaaggtggacagtgtgagagctgctgatgagatagctgctgaataaaactacattttacctgcc

SEQ ID NO: 30402 - DNA, 2164 bp, Homo sapiens
atagtcggctactctggaggctgaggcaggaagatccttagagcccaagaaattgaggccgtagtaagctgtgattacaccactgcactccagcctggacaacagagcgagaccttgtctcaaatgagaaaaaaacaaaaagaaatgggagaatccagagagactaggctagatcaagcctgctgggtcctggcaggagccccagggagtagctcatctgcagacatttgcttgaggactaccccctaaacataaaggaagaatgacatccaaagggtgtggagcagccatgagctgagaactagcctggtctacctgagattgatggcaggtctggctgctgagaggagctgcagatctggagaagacagcctaggtaaaggtggacagtgtgagagctgctgatgagatagctgctgaataaaactacattttacctgcctatggcccgccaggttttctttcagctatcgcccatccacccagtcccctcgaacctcagcatgggctggaacctgaccctgggcatgacatttggcatagttgtggacctgacacctgtgtttgtcctagtcctgtttctccctgccttcctgttcctctcgctgccctcatggtcactcccaagagatccaacccatgttaagtatgggctggaggactgcatgaatgcctcatgatcttcccagaggcaaaggcacctactgccttccaaggtcagtgggaggttgggatcaacactgtttattatgcttaggacaaaaaagatagggagaaagatgtgcaaccttacaggtcatctttctgggatagaacacaatgggtcttctcctgcctcctggatatgttagtcaaggccagtccatgctacacatctagtctgacttctaaaatagaagcaccagatgaattcagccctgagagaattttcagcagctgtgggggcgctggaggaaacactattaaatagttttgcacctgagacagatagcctcactcgcctcaccctagtcctggtggcatttgtctcaggtgcaaaatttaagaaagaaaccttggagtgctcaccctgtggctgggtagatggtcctaaagtggtggttttcaagcctgagctgtgtatcaggatcatcaggggagcttgctaaagagcagttcctgcggtcagaccctcatgcattttgagcaggtgtggggactgggaaactgcatctgtaacctgctgtaatctaacgcttatctaaatactactgtgctcacacagagaacaccgcaaaagtagaggtgttcctccagagggcaggtgagcagatggcacagtctgcttggaattcagtcaggtgatgagagatgagatgaggcactcctagctttgggaagagggagctgaaagatgaacctttgcaggtgcccacggtcaaagtggtggtttaatgccatgccatgcccattttctgttggccttggcagggagttacagccctaccttaggacctggctccttatttctgctgtaggctctttcctgccctggccgagatggagtggaatgagacctagaaacatcaagctaaatacatgtcctcagaaagataaaggtttacattttcacccccatcaaatctgaaagctctctgcctgtgtttttctaagggatagggacatcattactcagtccacaacctggactcatgtagggtcccctgtcagtaaaggagtcagtcaagcccaccaggtataccaaggactcttaccctcagcccctactccttggaaagctgccccttggcctaatattggtgtttagcttgagcctgactccttctcaacactaagagctgatgaagtcctgaagcagaaagagctctgacctgagagtcaaacatccttattctgatctcagctcagcccctgatttgttgtgtgaccctggatatgtcacttcctgtctttttgactttttaaaatgaagggtagactagaggagagcttctaaaactttaatgtggtcaacgaaatggaataggaaattccacaagtctgtccttccacaaaagcagcaaataaggtggcaaaaactcaaatttatgggaactctggaaacgaattgaaagtttacagcaatcaggtgaatacctaagaataaaagctggatttagtaaga

SEQ ID NO: 30403 - DNA, 2112 bp, Homo sapiens
ttcatacttggctcaaagccactattgtttggaaaaggtataactgccctgctgacgctgtacagatgttcttgggctcggatgggcatggctccacgtggtgtgcactagcacccagagagagtgaagctattgacccctgtaagggagagtgaccatctggcagatagatagaggggagccaggacatggctcagcttgtgcccagagggagagttaagccgctgaccctgtagccagggagtgcacctgcaagcatgggggtggcaggagccacagagctggctgctgagaggagctgcagatctggagaagacagcctaggtaaaggtggacagtgtgagagctgctgatgagatagctgctgaataaaactacattttacctgcctatggcccgccaggttttctttcagctatcgcccatccacccagtcccctcgaacctcagcatgggctggaacctgaccctgggcatgacatttggcatagttgtggacctgacacctgtgtttgtcctagtcctgtttctccctgccttcctgttcctctcgctgccctcatggtcactcccaagagatccaacccatgttaagtatgggctggaggactgcatgaatgcctcatgatcttcccagaggcaaaggcacctactgccttccaaggtcagtgggaggttgggatcaacactgtttattatgcttaggacaaaaaagatagggagaaagatgtgcaaccttacaggtcatctttctgggatagaacacaatgggtcttctcctgcctcctggatatgttagtcaaggccagtccatgctacacatctagtctgacttctaaaatagaagcaccagatgaattcagccctgagagaattttcagcagctgtgggggcgctggaggaaacactattaaatagttttgcacctgagacagatagcctcactcgcctcaccctagtcctggtggcatttgtctcaggtgcaaaatttaagaaagaaaccttggagtgctcaccctgtggctgggtagatggtcctaaagtggtggttttcaagcctgagctgtgtatcaggatcatcaggggagcttgctaaagagcagttcctgcggtcagaccctcatgcattttgagcaggtgtggggactgggaaactgcatctgtaacctgctgtaatctaacgcttatctaaatactactgtgctcacacagagaacaccgcaaaagtagaggtgttcctccagagggcaggtgagcagatggcacagtctgcttggaattcagtcaggtgatgagagatgagatgaggcactcctagctttgggaagagggagctgaaagatgaacctttgcaggtgcccacggtcaaagtggtggtttaatgccatgccatgcccattttctgttggccttggcagggagttacagccctaccttaggacctggctccttatttctgctgtaggctctttcctgccctggccgagatggagtggaatgagacctagaaacatcaagctaaatacatgtcctcagaaagataaaggtttacattttcacccccatcaaatctgaaagctctctgcctgtgtttttctaagggatagggacatcattactcagtccacaacctggactcatgtagggtcccctgtcagtaaaggagtcagtcaagcccaccaggtataccaaggactcttaccctcagcccctactccttggaaagctgccccttggcctaatattggtgtttagcttgagcctgactccttctcaacactaagagctgatgaagtcctgaagcagaaagagctctgacctgagagtcaaacatccttattctgatctcagctcagcccctgatttgttgtgtgaccctggatatgtcacttcctgtctttttgactttttaaaatgaagggtagactagaggagagcttctaaaactttaatgtggtcaacgaaatggaataggaaattccacaagtctgtccttccacaaaagcagcaaataaggtggcaaaaactcaaatttatgggaactctggaaacgaattgaaagtttacagcaatcaggtgaatacctaagaataaaagctggatttagtaaga

SEQ ID NO: 30404 - DNA, 496 bp, Homo sapiens
cagcgattgagataaatatattttgttattggtaatcttaagtgatgtatttttaaggctattttatatatcttctagttacatttaagtagatatcacaaatacagtatattttcccatctgctgcactcacgcttgaagctctgtgctggagacaggttggtggctgtttagtggcattggccttgacagcatgtgcaaggagcagcaaaatgtgagaagtcttccccgccaaggtgaggcaggtgtgaggagtggtagcatatggacacatgattaactggctgggtatgtatgacaaaaataattctactttaagctagttaaaattaattatcctaccttgccttatgccagatagaatgaattcatttttttctaaatatatggtttatttggcacaatttgggtgaatgtagttgagatgctttttacccatattaatgagcatttcataatgaatactttgtcctttggctgtatatacaatatagaa

SEQ ID NO: 30405 - DNA, 263 bp, Homo sapiens
atagatgaagtgaagagtgtatgctaagttgaatacagattggaaatgtcactgaaaatttatgtaggattttgaaaatagatgcatttggtgatttgatgacatttacaacattttaaaaataagaaatagttttcaaaaataagaaaccatgtgtaccatgatgtcatttaaaaaattcttttcattgctcactcttgtctaagaggaggatctgccaatatctgtgcttaatcgtttacttaataaatactttattaatt

SEQ ID NO: 30406 - DNA, 593 bp, Homo sapiens
ccgaaggtggcggcagcgggggcgtacgcacgggggcgtacgcacgggggcgtgtctggggagctctcgaggagcctccagccagcgctcctatacctgcgcgttccctgtttgcccccccctttgaagtcagtcgcccaatctgaaagccgtggatgcgcctgcgccctccatctcgtcaggtgtggctgtgagcgccgcgcattttccgataccgcgagacttctctgtttccgagcgctgtgaaggaactgagtgaattgaggctttgagttttcgttagccaagacgttgtgttgctctgtgttctttttggccgggagtggttatgtccgtgtcctactgttaggtcttttaggctgaagaatgcgttccttcccgctttggcaccagcgtcactggcaccgtttttgtcctgtgcttactgaccattctgcatcttttgtgaagtttcagttccagtcttctgcccgtttttaaatctggtccttcgtgtttaacagttctggatacaaatgttttgttagatatatgtatgctctgaatgaaaatcttttgttacataaatgattgcgaagtctttttcccaaact

SEQ ID NO: 30407 - DNA, 914 bp, Homo sapiens
  misc_feature (914)..(914): n is a, c, g, or t
ccgaaggtggcggcagcgggggcgtacgcacgggggcgtacgcacgggggcgtgtctggggagctctcgaggagcctccagccagcgctcctatacctgcgcgttccctgtttgcccccccctttgaagtcagtcgcccaatctgaaagccgtggatgcgcctgcgccctccatctcgtcaggtgtggctgtgagcgccgcgcattttccgataccgcgagacttctctgtttccgagcgctgtgaaggaactgagtgaattgaggctttgagttttcgttagccaagacgttgtgttgctctgtgttctttttggccgggagtggttatgtccgtgtcctactgttaggtcttttaggctgaagaatgcgttccttcccgctttggcaccagcgtcactggcaccgtttttgtcctgtgcttactgaccattctgcatcttttgtgaagtttcagttccagtcttctgcccgtttttaaatctggtccttcgtgtttaacagttctggatacaaatgttttgttagatatatgtatgctctgaatgaaaatcttttgttacacttaaaagaatatagaaaagcataaaaataataaaaaggaatttgttgggcgagagatgtgcgtggcctgttgagaaactctttttcaaaccgtctatctgtggggacggggggcccagtatgtgtttgtacaattggttcacccatgtgtccccggaaagatcaaccgggggagcaagataacagggggctggagtgtgtctcacgcatatataaaaaatcgccacggtgcggataaacaggtggttttctgtgaaaacacctggatgtggcaacaggagaaggcacgcatacgggggatttcacccccagggggaccgctaaagaggtcccagaaatttaaatggtccn

SEQ ID NO: 30408 - DNA, 343 bp, Homo sapiens
tatgtactgccatttgaggaaatggataagaatggtggacaccgagaagggctctggtgtaaatgggagaaatgggcaagaaaattacttacttttttaaaaattgaatttttagaacacaaacataactcttgctggttttttttcccaaatcattgtaacgcttttatttttatatctttgagtttctgcattcctaaagaataaaatgggtaagtggtatcttgaaaaattagccaggcattggtggtgtgtgcttgtattcctagctacttgggaggctggggtgggagaattgcttaagcccgggaggcagtagggttgtaatgaggactctttcaaa

SEQ ID NO: 30409 - DNA, 344 bp, Homo sapiens
agaagggaccatttgaaatattggtattagagaagtctcctctggtcaagccttcttaaggttttttgtttgttttattttctttgctttacacatatttccatcaaaagcaaagcatgccatagaaatgaggtattttgccttgtgttgtgatggtctgaattcaaatttactgtagagtgggcagtggaataatgataattttcattcaataaccttgtccttcttcccttctccaactaatgtcactgaatgtagtgtccctgagggagagtcacttaagaacagtagaattttagaaagaaacagggagggaagttggccttactgcattcagcaacaaa

SEQ ID NO: 30410 - DNA, 323 bp, Homo sapiens
gcagttttgcaataacatttatactcacctttaataacatgcagattaaagggcggtttatgcagaaaattctagggaagaggtagtaacttttgggtcatcgggtcatttccatagaaaggggtggtaactcccaggtgttgccacggcacaccagggggtgtgtctgattggaaagctgcttccacccaggccctgtttttgctagttctcagtctggtccggtgtctgagccccacctctggagtcaagtcctgcctcctacctcactatgactgtaccactgaactccagcctaggccacagagggagacccagtcttt

SEQ ID NO: 30411 - DNA, 461 bp, Homo sapiens
ctggaattataggcatgagccaccatgccctgcccaggcaccattcttgactgcgagaaagtcactgtgatggtttctccagcctgagttttctcctgtataaaatggaccttgttttgaggagagaatgaggtatgtggtactcgtgagcaggattttcaatgcctggctggttgttacttatccatttagtccgagcttcagggaaagaacatgacaccggcctccagcagagcctgctcttggtccactgtttatcctgggtgaccttaggcaagtcatttaatttccttgagttttggtgtaagtattgatggagcagaccatcaataactgttcttatgtctattattaccatgtgtctgtctacatgtttgtttgtaaattctctgtgggtaaaagttctcttttcatccccttgcctcagcacggagcccagagccagactgcaggtaggcact

SEQ ID NO: 30412 - DNA, 515 bp, Homo sapiens
atttctttccttctgcttgctttgggtttatattgctcttccttttccagattcttgaggtaggagcttcgattattgaattcagacttccttttttctagtatcaacatttaatgccatatattttattttaatttccattcaggtcagtgtgtgtttaaaacaaaattttcttgaggcttgctctttgacccatggattacttagaagtgtgttgtttaatttctaagtgcttgggtgtttgcctgttgtctagttcgagtccattttggttagaaaaccagtctgtatgatttcagtccttttacatttgttgaggtttgttttatggctcaggatatggtttatcttggtatatattcttgaaaagattgtatattttgctagaaagagatttcaaaaatagtaaatatgaatcaacctgaaggataaaaataaatgatttttctttcctttggcaatagaaatattgttactagttggacaagttatctttattcacagcctgagttata

SEQ ID NO: 30413 - DNA, 167 bp, Homo sapiens
tatattctaacattctcatttatagtgctttaatatatgagattattcagtattgataaaattgaaagtcaatttaattatgtgatactacattttgctttgggtaaatgatggattctagaagatctaaaggggtggctgctatattacctacatgtttggtttta

SEQ ID NO: 30414 - DNA, 373 bp, Homo sapiens
agaaaagtcagaaggtctacgtacaactttaagagttcagccaaaagagaccagtatctactaccgtggacaaccctatttaacatggaggagataagcagaaactgaaaagaggagcctgttttctctctggcagattaattttctttctttcttcacccatgccttggacatgaaacacaagtacaaaggttcagagaaaatcaaaacaagactgtggtttacaaataagtagtactagtaacatctcactgttggctgggcacagtgactcatgcctgtaaccctagcactttgggaggcagaagtgggaggatcacttaagcctagggttgaagaccagcctgggcaacatggtgaaacctcatttcta

SEQ ID NO: 30415 - DNA, 355 bp, Homo sapiens
ctgtgaagaaattttcaccctgtggggaaaaagttttgaatagatgtaatctcttgattctcaatattgcttaagatgagttcatctctcttagaacaaaggcaatgagaggtttgatgccaggaaagttgggagagctgggcaatcttagaaagagacctgggcactaagaggaatttgcatccaggcagtagttccagaattggcaaatcagtattatgtttgtgtatatattatatacacatcttggcaatgtagaacaagataagctacattttatcttctagaatttgatagccaaaatcacaggtcagaattttaaagtaaacagttttactatttcctcttcttgtag

SEQ ID NO: 30416 - DNA, 465 bp, Homo sapiens
tttttttcctactcggtaattgcatatcaataattctatagcacagaagtaataaaaataaaaacacatctatctgtcaattcatctgtcattgcttatagaagcttaaatatacaaaaataaggaagtggttacataataaaaaaattattcaatggattagtaagcagattaactatcatgatcagcaggaatattaaaatgaggaaataaatataattttaagagtaaactgcatgcataactctataaataaaatatataaattttggataataaaaactgtctaaaaggactatagcagttttttaagtggctattcctgagggaaataaaataatgattttatgtttttctttgtacttgaacctatttctaaattttctacaatgaatatttactacttttaaaatagcaattaaaaagaagaaagaaaatacatccttatctacaaaattcagcatg

SEQ ID NO: 30417 - DNA, 879 bp, Homo sapiens
ctcatagccagttgtgctgcagacagacaaaaccagagaagccgcttttcacggacatttttcttttttgcagatacctaggggttatcatggggaaacaaaggcatgtataaacctcattcagcagtcttttcagatagagtctgaaaagagtctatcaccaatctatctgaggtcagcttaatccatacccacagagatgatgagccaaaggcttccctaagctagggtcccatagtcttccccaagctagggtcccagcgctgggtgggggacaggagaaaaggcctgaggcacgggggagaaaaaggcagttgcagatagtaatgtttggaggcatgctcagttattcagaagaaatggaatgacgttaaaattctcccaaaaaaggttggaaccacctctgcttccctttccccactctgtaatcagtaatcattgtctggtgtgttcagatgataatccagttggccaccaaggggttgtgcttccttactgactgtatttgtgatctgtaagacttttcaaacacaggtttaaacatccagagactccagcctctttgacagtcattctcccactgtgtcccttttgacttcttttgtcatgtctctagtgcagatttcccagctgcccaatttgagcccttttgagttgacctcccttggatgagtagctctttgaaagctgatttaaagtgagtgttgctccacctaagagctgttggctgaaaaaagcactatctacaacagcagaggtggccgagaaaggcagacaggctctcctgaggctggtgttgcagatttgcattggtctagtaggaattatgcatcattagactgaacttcttatgtttgcatccaggtcatttctccataa

SEQ ID NO: 30418 - DNA, 1857 bp, Homo sapiens
ttctaagcaagagcaaaggatacttcatacttttttcgttatatgattgatcttcaaattgggatttacctttttcaatatgttttaaagtagtcttattcctcttttgatttgttaaacaagcattttagttcagctattgaatagccttccaaaaaattaattcagccttgcaggtaagtaccatactaagactttaacccaatagtttttaatcattctgcctttattccaaactgtaaatctgtacacataagataaaacatactaagtattgcataaattgttaacgttacagtaaattgttatctgcagggctgacagacataatgttggtgggcaactgtgatcctatacatacatatatgcaaaaggggattttaaaagtgcagattatagagtagattgacaaattttattttatattcagttgtcctctctgcttccatctgtgttgctctcttagttgagagagagttagccatttgacgattttaagtcagtgggaacttatttttagttactcaataaaattaatattttatttgtattttaacttacagagtaggttggtaataacagctgaactgtgtaacattgttgcttcaaattgaagtttatattatgaacattcagaatcaatgctcatgtagcagcatattattgagctattttgagtttgaaatgtggagaaacgctaaaccatgtactatgtgttaacataatcccaccttcttagagctttgttccttctgaaggtgtatagatacagcttgtcttgaaatgtctttctccacataatgaagcatgctgaatgctgggaatctggagcagcagccctgggagccctgagttttgaagtgttttggtttgcttcaaaggttagaagaacttgatatgtatggcaaacaactttagaatactagttactcactaacatgaggcgggtaatgttgctctagattctatattccagtaaagccagcttttcttattattggagtaggcaaatgaatggcattagaattagtgggtggcttgtaagttgtagttataggcactttaccacttcctgccattagcaggcatccttgttttttcttcttttccctctttgttccttcttttccctttctccttatacattttctttctctactttaattctccttcctccttactgtagatcccaagcttctagcttaggtttgcaagtcatattgcttggccctccacattcactgagaggtgaagataggctgaccccctgtcctcttacatttgagggatcatagactgctgtgtgaattctggaaagtctcaggtccctaccagggcactgaatggcttctcaatggctgtagagacagtacagttttccaaagcagcctaattcatctggacagctaccaggcactttggaaagttggttcagttactactatgaggccataatatatttgctggtattaaaattcttcagaattggaattactatttgaaataatattttggttgacttaagttttgagagacaattctaaaattgatctagagactcattcaatagcaatgtgaccttttaaatacttacattaagtaaaactgccagtagattaaatcatatatatatatatatatatatatatatgtaagagcttcctctatttactactgttgaacttcagtaatttttagaggctaaataatggtcagaatgtttttaagtgtgctcttttattacatgcttgtgcaggttttgtaattcagtacagaaaagtttaaccttgtacatttttgtatgtaaaaagtcttttaagtagtcttatccttatttaaataaacagaataaaatta

SEQ ID NO: 30419 - DNA, 2300 bp, Homo sapiens
ttctaagcaagagcaaaggatacttcatacttttttcgttatatgattgatcttcaaattgggatttacctttttcaatatgttttaaagtagtcttattcctcttttgatttgttaaacaagcattttagttcagctattgaatagccttccaaaaaattaattcagccttgcaggtaagtaccatactaagactttaacccaatagtttttaatcattctgcctttattccaaactgtaaatctgtacacataagataaaacatactaagtattgcataaattgttaacgttacagtaaattgttatctgcagggctgacagacataatgttggtgggcaactgtgatcctatacatacatatatgcaaaaggggattttaaaagtgcagattatagagtagattgacaaattttattttatattcagttgtcctctctgcttccatctgtgttgctctcttagttgagagagagttagccatttgacgattttaagtcagtgggaacttatttttagttactcaataaaattaatattttatttgtattttaacttacagagtaggttggtaataacagctgaactgtgtaacattgttgcttcaaattgaagtttatattatgaacattcagaatcaatgctcatgtagcagcatattattgagctattttgagtttgaaatgtggagaaacgctaaaccatgtactatgtgttaacataatcccaccttcttagagctttgttccttctgaaggtgtatagatacagcttgtcttgaaatgtctttctccacataatgaagcatgctgaatgctgggaatctggagcagcagccctgggagccctgagttttgaagtgttttggtttgcttcaaaggttagaagaacttgatatgtatggcaaacaactttagaatactagttactcactaacatgaggcgggtaatgttgctctagattctatattccagtaaagccagcttttcttattattggagtaggcaaatgaatggcattagaattagtgggtggcttgtaagttgtagttataggcactttaccacttcctgccattagcaggcatccttgttttttcttcttttccctctttgttccttcttttccctttctccttatacattttctttctctactttaattctccttcctccttactgtagatcccaagcttctagcttaggtttgcaagtcatattgcttggccctccacattcactgagaggtgaagataggctgaccccctgtcctcttacatttgagggatcatagactgctgtgtgaattctggaaagtctcaggtccctaccagggcactgaatggcttctcaatggctgtagagacagtacagttttccaaagcagcctaattcatctggacagctaccaggcactttggaaagttggttcagttactactatgaggccataatatatttgctggtattaaaattcttcagaattggaattactatttgaaataatattttggttgacttaagttttgagagacaattctaaaattgatctagagactcattcaatagcaatgtgaccttttaaatacttacattaagtaaaactgccagtagattaaatcatatatatatatatatatatatatatatgtaagagcttcctctatttactactgttgaacttcagtaatttttagaggctaaataatggtcagaatgtttttaagtgtgctcttttattacatgcttgtgcaggttttgtaattcagtacagaaaagtttaaccttgtacatttttgtatgtaaaaagtcttttaagtagtcttatccttatttaaataaacagaataaaattaccttgagtaggtctgttattcttattaaaatggaaaaatgctctgtaatgacttgatctgtttttatttgagtgaacaattttggaaagtattctttatagtacaactttctatacctggattgattaagatcagatgtgattcgagtagtccagccatatcttgtagcccttctttgaatgagagggtggctggagtggtctggtgctgggatatcacggtgctacagagcctgacatgttgactgtcactacatgttgagggatggaaatagaagtctctgaacttcccatgtaatattaaagctcttaacaaaatgagacaaactagagattcagttgagagattttatgttagagtgatctgaaaaaaagttaatttctaaactgctatcttaatattattatatttggagactgatgctgtaaattaaataacttgga

SEQ ID NO: 30420 - DNA, 2246 bp, Homo sapiens
ttctaagcaagagcaaaggatacttcatacttttttcgttatatgattgatcttcaaattgggatttacctttttcaatatgttttaaagtagtcttattcctcttttgatttgttaaacaagcattttagttcagctattgaatagccttccaaaaaattaattcagccttgcaggtaagtaccatactaagactttaacccaatagtttttaatcattctgcctttattccaaactgtaaatctgtacacataagataaaacatactaagtattgcataaattgttaacgttacagtaaattgttatctgcagggctgacagacataatgttggtgggcaactgtgatcctatacatacatatatgcaaaaggggattttaaaagtgcagattatagagtagattgacaaattttattttatattcagttgtcctctctgcttccatctgtgttgctctcttagttgagagagagttagccatttgacgattttaagtcagtgggaacttatttttagttactcaataaaattaatattttatttgtattttaacttacagagtaggttggtaataacagctgaactgtgtaacattgttgcttcaaattgaagtttatattatgaacattcagaatcaatgctcatgtagcagcatattattgagctattttgagtttgaaatgtggagaaacgctaaaccatgtactatgtgttaacataatcccaccttcttagagctttgttccttctgaaggtgtatagatacagcttgtcttgaaatgtctttctccacataatgaagcatgctgaatgctgggaatctggagcagcagccctgggagccctgagttttgaagtgttttggtttgcttcaaaggttagaagaacttgatatgtatggcaaacaactttagaatactagttactcactaacatgaggcgggtaatgttgctctagattctatattccagtaaagccagcttttcttattattggagtaggcaaatgaatggcattagaattagtgggtggcttgtaagttgtagttataggcactttaccacttcctgccattagcaggcatccttgttttttcttcttttccctctttgttccttcttttccctttctccttatacattttctttctctactttaattctccttcctccttactgtagatcccaagcttctagcttaggtttgcaagtcatattgcttggccctccacattcactgagaggtgaagataggctgaccccctgtcctcttacatttgagggatcatagactgctgtgtgaattctggaaagtctcaggtccctaccagggcactgaatggcttctcaatggctgtagagacagtacagttttccaaagcagcctaattcatctggacagctaccaggcactttggaaagttggttcagttactactatgaggccataatatatttgctggtattaaaattcttcagaattggaattactatttgaaataatattttggttgacttaagttttgagagacaattctaaaattgatctagagactcattcaatagcaatgtgaccttttaaatacttacattaagtaagcttcctctatttactactgttgaacttcagtaatttttagaggctaaataatggtcagaatgtttttaagtgtgctcttttattacatgcttgtgcaggttttgtaattcagtacagaaaagtttaaccttgtacatttttgtatgtaaaaagtcttttaagtagtcttatccttatttaaataaacagaataaaattaccttgagtaggtctgttattcttattaaaatggaaaaatgctctgtaatgacttgatctgtttttatttgagtgaacaattttggaaagtattctttatagtacaactttctatacctggattgattaagatcagatgtgattcgagtagtccagccatatcttgtagcccttctttgaatgagagggtggctggagtggtctggtgctgggatatcacggtgctacagagcctgacatgttgactgtcactacatgttgagggatggaaatagaagtctctgaacttcccatgtaatattaaagctcttaacaaaatgagacaaactagagattcagttgagagattttatgttagagtgatctgaaaaaaagttaatttctaaactgctatcttaatattattatatttggagactgatgctgtaaattaaataacttgga

SEQ ID NO: 30421 - DNA, 1015 bp, Homo sapiens
caatttgcagggctacaccttcacagggctaccatgtctgatatcagtcattttttcaggacaggtacagagggagcgagtttctgcatgcctaaaaagcctttattttactgtcactttttttttctttcttttttgtagagacagggcgagtccatacagtaaagtgaaagcaagtttattagcaaagtaaaggactaaagaaaagctgctccatagagcagccccgagcgctgctggttgcccatttttatggttatttcttgattatatgctaaacaagaggcggattattcatgccacccttttttagaccatattaagtaacttcctggcattgccatggcatctgtaacctgtcatggcgctggcaggagtgtggcagtgaggacgaccaagatcactctggttgccatcttggttttggtgggttttgggctgccttctttaccgcaacctgttttatcagcaaggtctttacgacctgtatcttgtgatgacctcctatctcatcctattacttagaatgccttcaccattggcattggcagtgcagcccagtaggtctcagcctcattttaccccgcccctactcaagatgaagttgctctggttcaaacgcctctgataccatgagattttgaatctcgatactttcttctgggaacttgttcttcttttacttcttcattctcacatcccagcccctgattttctctgtttcctctttctgaaacttctagtagacactgtacttcctggcacagtatcctccctcaatttttcacttatatactcttttagtgtcttcgtattctaggaattttttttttacttaatcctctagctcttctacaaaatgttctgttttgttaatcatgtttaacataattttgatccttttaaatgtattgagacctatcttggtgaatgttccatgtgcaattgaaaagaatatgtactgtgctgttgctgggcggagtgttctataaatgtcacttaggtcaagttgttt

SEQ ID NO: 30422 - DNA, 1343 bp, Homo sapiens
gagtggacttagcagcttactagcaagcttatcttgtctttatagaaaatgtaagaataaatgtgtagaagatagagataattcccattctgcagacccttacctttcatcaaaggaagggaaatattgtctacttctagcctgcctttataaactttataagctctcaacattaaaggataaataaactttagtttttcactgagaatcttatggcactgaggaatggactgacttactcttcagtccaatcacatttgggaagacacaggtctctgatgtataaagcagaaggccactaagaattttattaaatttcaaacttattatatgccacccctttttaaaactaaatccaggtataaaagtccatcatgtagacttgaattttactattaaatccactaatacgaacaaattctgggacataattatctgagttatgaattgagagtgaaaataagatcctcattaacaactctaaggctaaaagattcaccaaatcttacagaataaggtcagtgctgctgacctttatagatccctggatgtggtgggagttgcctatagtcctagtacgtgggaggatgaagcaggaagatcacttgagcaaaggagttcaagtccaacctgggcaacatagcaagacccgatctcttttaaaaaaaaaaaaaaaaaaaagtatacattccagacagctttctgattgggttttgaaaatctccctcaaattacacagcagtgaagcaatgtacacaactgggaaagctttttaacctctaaaactattcaaagacttacttatagggatctgtttgccagcatactaatcaattctgtgtatgattttgttgtactaatcaatcctaggtatgatctggtcgaacccaatatgcagttattcatcttgaaaaaacagctgttttcttcagttgtctactagttaaaataattaggcatgccatctaaaaggtacacacagttcgtcttgaaaacttacaaatgcctgtagaatgattatatttcagttaaaaaaaaaaaaagaaaatgagctctgcataatctacatgtatatgcttgtgtgtgtatatatatacatatataaacaatgataaatgggataaagtatacataccaggctcttaacattgcttttcctcatcagactgggattgggttagaaaagagggctgagaaacacaattagcttgcctttatttgtatttttattgtattgtttcatttgttttaaaaagagagtaagataattatgcaggatttcagtttaatagtaagcgtgatcttcgtttgttgtaaggcattctactaattgttgacttgat

SEQ ID NO: 30423 - DNA, 340 bp, Homo sapiens
tgtattacttttttaaaatgcaaaaagttatttgtttcaaactctggttccagttgtttctgttaaagaaccagggcctcactgcagtgagctatggtcataccactgcactccagcctgggcaacagcaagatcctgtttcccaaaaagaatcatggcctcacagtaagggtaacagatttctggttagacctggatttaaattctaatagcgggctgggcactctggctcatgtctataatcccagcactttaggaggccgaggtgagcggatcacccgaggtcaggagttcaataccagcctggccaacgtggtgaaacactgtctctactaaaaat

SEQ ID NO: 30424 - DNA, 1645 bp, Homo sapiens
ggattgaattgcactgaaatgaaataactgcttaggcatgtatctttacatatgatcccagtattgcaaagtacaagagagaaaaagttattttatagctaaaatcaggaaattataaaaacaggaaataataacaagagttttaatgaaagataagtgaaaatgctgtaactttttgtttgcatgtttgtctgtttaaaattgaggtataattatgtaaactaaaaaatcatctattttggctggacgcagtggcttacgcctgtaatcccagcactttgggaggccgaggcgggcagatcacttgagatcaggagttcgagaccagcctgaccaacacagtgaaaccccatctctactaaaaatacaaaaattagcagggcgtggtggcacacacttgcaatcccatctgctcaagaggctgaggcatgagaactgcttgaacccagaggcagaggttgcagtgagcggagaccatgccactgccctccagtcagggtggcagagcaagactccgtctcaaaaaaaaaagagagagaaaatatatatatattttactgttcaatttgatgagtttcagcaattttatatatctttgttaaccaccatgcaacacaacatacagaacatttccatcacacttcaaaattcccttgcgtctttttccagtcgatactgcccctccccactagtaatcattcttctgactcctctcactgtagatttgctgtgcctgttcatgaatggaatcatacaatatttgttcttttgtgtttggcttctttcattcaatacagtgtttttgagattcatctgttttgttgcttatattagcagttcattcgtttttattgagcaatacttcattgtatgaatacaccacaatttatttctgtaatgataggcattaggattggttccagtttttgactactatgaatacaaattcagtgaaaattcttatgcaacttttttttagccacatttttatttcttttgggtcaatacctagaagtagaattgtcctgtcgtgtaaatatatgtttaactttataagaaactgaccagtagttttctgaaacgattgcatcattttacacccccgtcagcaatgtatgaaagttctagttgctcttcatgctcactaacatctgatattgttctccatttgattttagtcatgttagtagatgtaagatgttagttgcatttccctgatgagtactgatgttgagaacttttcatttgcttgttagccagtcacatattttcttttgtaaattgactgttccaatcttttacatgttcttaaatctcattatttttgttattcatatcaacagttaccaatagggcatttttatattttatcactagaaatcctttgtcacatatacatacctatattgcagatatttttcctcaaaggcatgtcttgcttattcattttcttttccttagtgatgtcttttgatgagcagaaatgtcttgatcatggtagttttatagtagtcttgaaatcaggtgatgtaagttatctttttcaagattgttttgactaatatagattctttgatttttccctaatgtggcaatcaacctttcctgccaccagaggtatgctagaagaaaaaaaaaaaagaag

SEQ ID NO: 30425 - DNA, 1159 bp, Homo sapiens
  misc_feature (32)..(32): n is a, c, g, or t
  misc_feature (42)..(42): n is a, c, g, or t
  misc_feature (101)..(101): n is a, c, g, or t
  misc_feature (204)..(204): n is a, c, g, or t
  misc_feature (320)..(323): n is a, c, g, or t
  misc_feature (1041)..(1041): n is a, c, g, or t
ggctcttcgcgcgcagtcccttagggggcgcntggaagcccnggcatgcgccctgagggctcgctgacctaccgggtgccagagaggctgcggcagggttnctgtggcgtgggtcgggcagcacaggccttggtgtgtgcgagtgccaaggagggcaccgccttcaggatggaggctgtgcaggagggggcggccggggtgganagtgagcaggcggctttgggggaggaggcggtgctgctgttggatgacataatggcggaggtggaggtggtggcggaggaggagggcctcgtggagcggcgggaggaggcccagcnnnnacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcgtgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacngcagtactcagcatggtcttatgcacaggaactaaaggaaaaagagatcgagtcacaaaaattcaggaagagggggtaaatgtggattgtatggaatgaaaaataaacattctcaagg

SEQ ID NO: 30426 - DNA, 1748 bp, Homo sapiens
tcccacacccgacgctctggcccacacagacgctactctgtagcatctcaggttccctctggctgcactctggaggaccacactcgttttctttttggctgccagaggcccccgcatccaccgctgagctgggagaaagatggcggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30427 - DNA, 845 bp, Homo sapiens
agtcacggtggcaggtgcctgtaatctcagctgcttgggaggctgagtcaggagaatcgcttgaactcaggaggtggaggttgcagtgagccgagatcctgccactgcagtctagcctgagtgacagagcaagactccatctcaaaaaagaaaagtatttattgtttttattttttttgaatagcttttttctgttttttaggtatttaaaaggaacatgcctcttccaagaataggcatgtaaaaagtatatatcttttaactcacagttgctgtgaatacaaaggaataattttaattttgtacattttttttccccttagcacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30428 - DNA, 567 bp, Homo sapiens
attcacttggaaacaaagtgattaaccctttggagaaaattaatcactttgtttccaagtgactaattttctccaaaaggttattcactggaaacaaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30429 - DNA, 333 bp, Homo sapiens
tcccacacccgacgctctggcccacacagacgctactctgtagcatctcaggttccctctggctgcactctggaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30430 - DNA, 1672 bp, Homo sapiens
ggacgcgtgggtcgacccacgcgatcgagaggcccccgcatccaccgctgagctgggagaaagatggcggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30431 - DNA, 1637 bp, Homo sapiens
aggctagtagagccgcgggtgaatcggccgaggggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30432 - DNA, 2140 bp, Homo sapiens
tgaggtcggctggggaggcaaatgttgggagaagcagaaagctggaggggaccttgtgcaggggccttcgaggctatagacttgaaatgattgtcagcttgttcagttcttgatagaatctttctggtcccttaggattttggaacagcggtctgagagacgactgctaccctggccttagtagccttccctggtacctcttcccatcgctggccggcctcacaccgaatctggcctctctttggaccttcctcctctttttttttgattcagagaaatgtatattctggggccttgatgctgcgtttttcggggagatggcttcttggggctggctgaggttgaggcggtatggccgctgtcatgtcgtccagaccattcagactgtcttctgtgggtccttgtgtttcgggtattttctctgccaccaactctgatggcacataggcggaatgtgctcatatcgtgggtcaggatgtctacagtagtgatgtttgcaggaatctgaattttgtcgaaatttatatagaatgcttaggttcactccaagttaaaatgtgtgacgtgcctgttctgcaagcagttgtcaacagtattaagcataggtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30433 - DNA, 1701 bp, Homo sapiens
ggacgcgtgggtcgacccacgcgatcgagaggcccccgcatccaccgctgagctgggagaaagatggcggcagccgtgcgacaggatttggcccagctcatgaattcgagcggctctcataaagatctggctggcaaaacattattttcatttggtattgttgtaggtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30434 - DNA, 1699 bp, Homo sapiens
tcccacacccgacgctctggcccacacagacgctactctgtagcatctcaggttccctctggctgcactctggaggaccacactcgttttctttttggctgccagaggcccccgcatccaccgctgagctgggagaaagatggcggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagattgtttaaaacttgttatccattaaaacgaattcccaccccccaagggtttttataaggaaaccc

SEQ ID NO: 30435 - DNA, 1388 bp, Homo sapiens
aatgtgataggtcgcccggtgtgattcatgcagaggctcgcttggaaaatatccagtcctacagtgatttcctttgagagagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30436 - DNA, 1470 bp, Homo sapiens
tcccacacccgacgctctggcccacacagacgctactctgtagcatctcaggttccctctggctgcactctggaggaccacactcgttttctttttggctgccagaggcccccgcatccaccgctgagctgggagaaagatggcggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatagcacctgcccgggatcctctagacga

SEQ ID NO: 30437 - DNA, 1259 bp, Homo sapiens
taacataccccattcaaattctagacttatcgagaaaacaatgaaaagaaagtcatacgaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30438 - DNA, 1002 bp, Homo sapiens
gctgtatatttagtagacaaaaatgaggtcataagataggtttttttttcctgaagaaacattgtgaaaataacattgtgaaatttgatgctcatttatttctcttagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30439 - DNA, 818 bp, Homo sapiens
tgccccactgaaggtgtctccaccggcacgttgaaatcaacttcaagaatttgctgccatgctgatgcctcaccaaaaagcaactacagctgatggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30440 - DNA, 754 bp, Homo sapiens
cttggcttcccaaagtgctgggatgataggggttccagcatcttggacagagctgttattgaacacaatttgttgtctgcaagcaaattatataataatattaccttcgaagaacttggagctcttttagagatccctgcagctaaggcggaaaagatagcatctcaaatgataaccgaaggacgtatgaatggatttattgaccagattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30441 - DNA, 522 bp, Homo sapiens
gggtgctctagaggtcccgggcaggtgctatgatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaagcatttaaaatatgtagttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcatgcctctccaaatgtggttattctaataaatggagaaatgagccaaataaaagtagtactttgtttttagata

SEQ ID NO: 30442 - DNA, 1189 bp, Homo sapiens
tcccacacccgacgctctggcccacacagacgctactctgtagcatctcaggttccctctggctgcactctggaggaccacactcgttttctttttggctgccagaggcccccgcatccaccgctgagctgggagaaagatggcggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcagggctacagcgttctcgatgctacatctctttttaaggtgaaaggggccacaacctgctgcctttgggatcctcaaaaaagttctttatgggttcttaagggaatcaaccttataaattgatgccttcttatgcttaccaaaaacacctccagtgttggttccccccttctggcactgactttattgaacccatattggtgtctgcagccaagtcttttaaaatataaccttgcagatcctgggagcttttttaagaatcctcgcatctagtgtgtgaacgattcctttataattatccctcagggcgtctaaatgttttttgccccatagaggta

SEQ ID NO: 30443 - DNA, 1101 bp, Homo sapiens
ggacgcgtgggtcgacccacgcgatcgagaggcccccgcatccaccgctgagctgggagaaagatggcggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggttgcttccataagacagcatcttgcatctatatatgagaaagaagaagattggagaaatgcagcccaagtgttggtgggaattcctttggaaacaggacaaaaagagaagagaagggaaaaccaaatagaaacaaaacaaaaacaggtacaaaaatagaaaatagagacgagaaataactaaaccaagaagaaagagctaagctaaagacaaggataaggagaaatggccagacccgaaacagagagcaacgaaaaggacgagcatacgtttagcatcgatgagtacaatccaatgaacaaaaaacagatactagaacagagaaacgagatctcgagacgaagaaatgatgaaggaaactcaagaaggccagccaaaggaccatagagccgactcttactggagaagaagtcatcatcttaggactcatattagctgcaagggggcagacgattccaagggcaaagcattgcaacggcgagtcttcccgcgatgcacgaaaagaattacccccttcaccaggaaggcagggcccggccaatgctccgaaaaatcacattgcactatgccaaggtgcggcgctgcggcccaccacgggagagagaaggccccccatcgcactgcaaaaccccaagaaggccggagacccatgaacgccgtaaaagaagagaaaagggaacccacgggacacagaaaacatgggccggatctccccaacacggagggcggccc

SEQ ID NO: 30444 - DNA, 810 bp, Homo sapiens
ggacgcgtgggtcgacccacgcgatcgagaggcccccgcatccaccgctgagctgggagaaagatggcggcagccgtgcgacaggatttggcccagctcatgaattcgagcggctctcataaagatctggctggcaagtatcgtcagatcctggaaaaagccattcagttatctggagcagaacaactagaagctttgaaagcttttgtggaagcaatggtaaatgagaatgtcagtctcgtgatctcgcggcagttgctgactgatttttgcacacatcttcctaacttgcctgatagcacagccaaagaaatctatcacttcaccttggaaaagatccagcctagagtcatttcatttgaggagcaggtaaaaatctagagaagtggttttttaacttgagatagcagcagttattttgagaatctgatattagtaaattcttaaaggagataatcatccaatttcatttttgacaaaacagtgtgccaaacgacattttatgatgcaaaatcaagtaaatattaggttgttacaactccaactgacatttgcttataaagtaaaatttgattttgtgaatcaaatattgctctctagacaattttttaaaatcagtaaaattggtatttcagctgaaaacacaggaaaactccagcatcgtgtatgcaggaacatacaagctaaatttaatgtttaaactacagtattgtaccataatccacattgcagaaatgtgttgcttccgttcactagtttgatattctgtaaatgcaaaattcgtaggaaaacttgggtggtcttgataaa

SEQ ID NO: 30445 - DNA, 277 bp, Homo sapiens
tgacctcatgatccgcctgcctcggcctcccaaagtgctgggattacagatgtgagccactgcacccagacttactgatgctttttaacaataagagttgctttggaaagattgtctccaactttataaaagtagtagcctatgaaaagaaaaacaagagccgggtgcagtggctcactcctgtaatcccagcactttgggattccgaggcaggtggatcacctgaggtcgggagttcaagatcagcccgaccaacatggagaacaccgtctctact

SEQ ID NO: 30446 - DNA, 365 bp, Homo sapiens
gatttgtgagaacagacaaaagatattgaaagccgactccagcaaacaatgcagataactctgcaggatgacaatggatccggaataggaaatgttacaatggtaacagccagctgagacctgaccaggggcccggagacatttccaagaggatggaggagcccttctcagctacatctcagaaataaatgcacagccttctaagggactactgtgaaagacaaggtgttctggactacatattacaaaagtgccatgttttactatgaaacctgtctcattgccttgtagccacattgcacttttctttggtaaccatcaaaatattttgcattgtgtcaggcacatgatggaaacaaaaaaaa

SEQ ID NO: 30447 - DNA, 520 bp, Homo sapiens
taatgatgcatttctcagagcgtatcaccgttgtgaggcttagcatgactggtctcatttcacttacacgaggtacctaaaatacattcatagatgcacaaaatagagtgctgggtgttgcgctgagagagggaagaaatggagaatcagtgtttagtgggcacattgttttagttttagaagatgaagagttctggaaatggatggtggcgatggttgcacacattgttaatgtacacagtacccctgagcactactgtttgtgccacagggctgagcagggcaaaagctggacccacgggcctcacaccatcctctgggctccatccctgtcctcctacctctcagcctgcctccctctgaaatttttcctcactgcctcagctacagctccctcatcttcctccatcctttattgaattggaagtcattgttatccaactagacaataagctctctgaggccagagcctggcctattctaaattttttttttttaagtcctgacagttgccaaaaaa

SEQ ID NO: 30448 - DNA, 482 bp, Homo sapiens
tggaaactgtgggccattacagtagtcccccgcaatccaaggttttgcttttcatggttgtccacggtccaccatggtctgaaaatattaaatgaaaactttcagaaataagcgattcataagttttaaattgtataccactctgagtactagaccgtgatgaaatcacccaggacacagattccccctttgtcctgttgtagacactgcccacccatgggtcacttagtagctgcctcagtgaccagatcaacagttgtggcatcaaagcgcttgtgttcaagccacacttattttactcaataatgtctccaaagtgatggcaagagtggtgatgctggcccttcagatatgtcatagagaagctgtagagtgctccttttaagtgaaaaagtgaaagttcttcacttaaggaaggaaaataatcgtatatggaggttgctaagatctatagtaagaacaaatcttctctcttgaaattg

SEQ ID NO: 30449 - DNA, 519 bp, Homo sapiens
ttaaacccttcccttccatggctggaagttctgtgccccagaattcccttggttcctgcatgttctccaagctgttctacatctaagagctcatcacgtctggtttccaggtgggtttggccagtgggaaacccaggcaggagatcagagaggatgaggagaatggggtcaggacaactatttcctcccttgtggtgacataaggtaggctgttaacagagggaaactgtcagaagtatttgaaccagagcaactccatcttgaatgggggctgggtaaaataaggctgagacctactgggctccattcctaggaggctaggcattcttagtcaaaggatgagataagaggttggcacaagatacaggtcacaaagacaccactggccaagacccaccaacactaagatggtgataaaagggacctctgttcgtccccactgctcattatatgctcattataatgcattagcatgcgaaagggctgctattctctaataaacttgctttcactttaaaa

SEQ ID NO: 30450 - DNA, 806 bp, Homo sapiens
tgccctgtggagagcccacccaccgggcttgggcggcctctttcctgtgatctggccatgaggcgctgcagagagccccagggtgtgatcctaacacagtgtctcttgaggcttctttccctgtagctagattgttagtcgaggaaccaggaacagtgagaatcaaaagccccgatctcttccgctgtctgtgcctccctcagtcgcctctgggcacactcatgctcatttacattcttattttttttaattgaaattctatgttggaaaatccagctcatggccatgcatgtccctgagtgtacaggtgtagttttctccacctactttaaaatgattaaagttgagagttcctggggagaaaaataaacggttagctgttgatatatttgagaagcgcagattctcccagcctctccgactggtttgcagaagtaactattctacccgaatttctctagcatctgtcaggacacaggcagacgtcttcatgtgtgatgagtccacactggcttataaacgaaggggctggagcttggattcctaaggatagaacacccagaaactcatacctggggggctggaaaccttccggttttcaaccagcaatgagcagggcttcttcagcctgcgggtgttcccctcaagccttgacttgagagcgaggcagggctgagcttcctgctgtcccggagcctgggcctggctgccgtgcacggctcagctcagagctccgagcacactgtccttctggggttaagtgctgggtctggccacatctggttttggcagtatgttgttaggga

SEQ ID NO: 30451 - DNA, 468 bp, Homo sapiens
agcattctcacgtgatatgaaacaattgataattaggatacaatttataatccgaaactgatgtgtttgcctttgaattactcattcatctataagtttagtccttttattagatgaattctgtgtttattggatgcaaaaaagaataagacaaaagcaaaagagtatcaccttaggggaaatacatatatatcaaagataattagcacaaagtagttcctgctatttatacttttccagcagatttactttcttagttttttttttttttttggccgatgcttttactaaaagtactttgctttgttagcattcatgctaccaagagtaaacagtcaatgattgttatttataattattgttgttattattttactgctatcacccaataaaagagatcactctgaaggcatatggggacagggagggaaaatcagtaaacttttaggtatatttattataaataat

SEQ ID NO: 30452 - DNA, 412 bp, Homo sapiens
gccaagagctaggaccagagtctgactcttttctggtttggggaggagatgcgagggtggggagggtgtccatgttcattgagtttctggacttctagatggtgcggggcagttgctggctctcacccaggttgagattttgctgggcttgttctcaaagttattggcagctcccaaaaatgatggagaaaggagatgcatagtgatggctgccttctttgactctgaaattggccaatggacaacagataaagtgaccagcagctccattttgtcccaaatgtgacatctggtttaccatgttgtcccagtggaataatgaattgttccttttttcccactctcagaggcctggtttgggcagtaaattatatggtcatccgagggaccctccaataaagaatcaagtgca

SEQ ID NO: 30453 - DNA, 2879 bp, Homo sapiens
agccgaacctcgggagcccaggacgccctcctgcacatgcgcaggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacagacaggaattccactcgagtccggcagagaaggcggctttggaggcgttctcagcccacgtggacttctgcaccctgttccactaccaccaaatcctggcccggctgcaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagcctggttgggagtcttggctccatggcacggccccctcctgtcattctttcctctacctgagctgacactctccctacaagagatcctgcgcgctccctgtgtgggctccaggtggtccccttgcctacaggagcccccaccttccctgcccaagagcccctgactggtccccagacgaaagccccagagctgggccttctggccctctcgaccctcctgggccttgttccgctcccctccaagcctcaagatcactcctaggcttctcccaaacccaggcccttcctgttctttgccctacgcccctccttgctgctccctcgaatcttccccgatctcagtgtgacctcagaacacctgcctctccccttgcagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtcgttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaataagtctggatgaggctactcttaacgcactgcctttagggtaaccctgctctgtaggagtggttaaaaaattatttttaaaaatctagatgagtgggatggctgcaggagttggagggaaggaaagcatttgaatcctggaaagaggggagggactctagctaggtcttggggtcccagacagagaaagctgtagtcctaaaaagaggctgggttcatggtcggtgaaacaaagacagtcatagaagaggatcttagaaggatctgattccagaggagtcccagggcctgatgaacagaggagatagcgtagccatgtgcgattgtgcagatttgcagatttttttttgttcttgagatggagtttcgcgcttgttgcccaggctggaatgcaatggcgtgatcttggctcactgcaacctccgcctcctgggttcgggtgattctcctgcctcagcctcccgagtagctgggaccgcgggtgtgtgccaccacaccaggctaatttttttgtatttttttgtagagacggggttttgtctcattgcccaggctggtctcaaactcctgagcacaagcaatacgcttgccttagccacccaaagtgctggaattacatgggtgagctaccgtgtccagcctcaatttaaaaataaagagcataattgcattgtttgtaacacaaagaataaatgcttgaggggatggataccccctttaccctgtgattattatgcattgcatacctgtatcaaagtatcccataaatatatacacctactatctacccac

SEQ ID NO: 30454 - DNA, 3505 bp, Homo sapiens
agccgaacctcgggagcccaggacgccctcctgcacatgcgcaggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacagacaggaattccactcgagtccggcagagaaggcggctttggaggcgttctcagcccacgtggacttctgcaccctgttccactaccaccaaatcctggcccggctgcaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcacttctgggccctgggccagcgagtcgggcagatgcccctgaagtccagcgtgggctccaggcgtggcttcttcaccaagctgccccctgcggagaggtgaggcggcccttgttccccagctgcagcaagagggagcaaggttagagtcaagaggggactgacagggaaagtgagtactacacttgattcccaggggaagagaaaggatggggacagttctccccattttccaataaggaaaactgaggctcggcagagggaggtccacattctgaagatgcggcacggccaggattccaacaaacaatctgcacgtccaataccagggatcgatggcgcgattgaaccgatcccctgtggttggacacagctgatccctggtttcttccccatgattactgagtcgcttttaagatggttgtgcgactgtagagccagagtgagcgtcctaggattggagggggctccccgggcagtgcagtcccgatcctgctcctgcctctgtctctgtccctcaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtcgttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaataagtctggatgaggctactcttaacgcactgcctttagggtaaccctgctctgtaggagtggttaaaaaattatttttaaaaatctagatgagtgggatggctgcaggagttggagggaaggaaagcatttgaatcctggaaagaggggagggactctagctaggtcttggggtcccagacagagaaagctgtagtcctaaaaagaggctgggttcatggtcggtgaaacaaagacagtcatagaagaggatcttagaaggatctgattccagaggagtcccagggcctgatgaacagaggagatagcgtagccatgtgcgattgtgcagatttgcagatttttttttgttcttgagatggagtttcgcgcttgttgcccaggctggaatgcaatggcgtgatcttggctcactgcaacctccgcctcctgggttcgggtgattctcctgcctcagcctcccgagtagctgggaccgcgggtgtgtgccaccacaccaggctaatttttttgtatttttttgtagagacggggttttgtctcattgcccaggctggtctcaaactcctgagcacaagcaatacgcttgccttagccacccaaagtgctggaattacatgggtgagctaccgtgtccagcctcaatttaaaaataaagagcataattgcattgtttgtaacacaaagaataaatgcttgaggggatggataccccctttaccctgtgattattatgcattgcatacctgtatcaaagtatcccataaatatatacacctactatctacccac

SEQ ID NO: 30455 - DNA, 2293 bp, Homo sapiens
agccgaacctcgggagcccaggacgccctcctgcacatgcgcaggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacagacaggaattccactcgagtccggcagagaaggcggctttggaggcgttctcagcccacgtggacttctgcaccctgttccactaccaccaaatcctggcccggctgcaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcacttctgggccctgggccagcgagtcgggcagatgcccctgaagtccagcgtgggctccaggcgtggcttcttcaccaagctgccccctgcggagaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtcgttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaata

SEQ ID NO: 30456 - DNA, 2929 bp, Homo sapiens
gacccctgcacagtcgttcctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcacttctgggccctgggccagcgagtcgggcagatgcccctgaagtccagcgtgggctccaggcgtggcttcttcaccaagctgccccctgcggagaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtcgttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaataagtctggatgaggctactcttaacgcactgcctttagggtaaccctgctctgtaggagtggttaaaaaattatttttaaaaatctagatgagtgggatggctgcaggagttggagggaaggaaagcatttgaatcctggaaagaggggagggactctagctaggtcttggggtcccagacagagaaagctgtagtcctaaaaagaggctgggttcatggtcggtgaaacaaagacagtcatagaagaggatcttagaaggatctgattccagaggagtcccagggcctgatgaacagaggagatagcgtagccatgtgcgattgtgcagatttgcagatttttttttgttcttgagatggagtttcgcgcttgttgcccaggctggaatgcaatggcgtgatcttggctcactgcaacctccgcctcctgggttcgggtgattctcctgcctcagcctcccgagtagctgggaccgcgggtgtgtgccaccacaccaggctaatttttttgtatttttttgtagagacggggttttgtctcattgcccaggctggtctcaaactcctgagcacaagcaatacgcttgccttagccacccaaagtgctggaattacatgggtgagctaccgtgtccagcctcaatttaaaaataaagagcataattgcattgtttgtaacacaaagaataaatgcttgaggggatggataccccctttaccctgtgattattatgcattgcatacctgtatcaaagtatcccataaatatatacacctactatctacccac

SEQ ID NO: 30457 - DNA, 3083 bp, Homo sapiens
agccgaacctcgggagcccaggacgccctcctgcacatgcgcaggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacagacaggaattccactcgagtccggcagagaaggcggctttggaggcgttctcagcccacgtggacttctgcaccctgttccactaccaccaaatcctggcccggctgcaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcacttctgggccctgggccagcgagtcgggcagatgcccctgaagtccagcgtgggctccaggcgtggcttcttcaccaagctgccccctgcggagaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtcgttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaataagtctggatgaggctactcttaacgcactgcctttagggtaaccctgctctgtaggagtggttaaaaaattatttttaaaaatctagatgagtgggatggctgcaggagttggagggaaggaaagcatttgaatcctggaaagaggggagggactctagctaggtcttggggtcccagacagagaaagctgtagtcctaaaaagaggctgggttcatggtcggtgaaacaaagacagtcatagaagaggatcttagaaggatctgattccagaggagtcccagggcctgatgaacagaggagatagcgtagccatgtgcgattgtgcagatttgcagatttttttttgttcttgagatggagtttcgcgcttgttgcccaggctggaatgcaatggcgtgatcttggctcactgcaacctccgcctcctgggttcgggtgattctcctgcctcagcctcccgagtagctgggaccgcgggtgtgtgccaccacaccaggctaatttttttgtatttttttgtagagacggggttttgtctcattgcccaggctggtctcaaactcctgagcacaagcaatacgcttgccttagccacccaaagtgctggaattacatgggtgagctaccgtgtccagcctcaatttaaaaataaagagcataattgcattgtttgtaacacaaagaataaatgcttgaggggatggataccccctttaccctgtgattattatgcattgcatacctgtatcaaagtatcccataaatatatacacctactatctacccac

SEQ ID NO: 30458 - DNA, 3441 bp, Homo sapiens
gacccctgcacagtcgttcctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcacttctgggccctgggccagcgagtcgggcagatgcccctgaagtccagcgtgggctccaggcgtggcttcttcaccaagctgccccctgcggagaggtgaggcggcccttgttccccagctgcagcaagagggagcaaggttagagtcaagaggggactgacaggtcagtgtctggtttgggtgtctgggccccaggcgggaagttgagaaatgggaggcgtgactcatccaaatgctgtcttttcttctcaagggaaagtgagtactacacttgattcccaggggaagagaaaggatggggacagttctccccattttccaataaggaaaactgaggctcggcagagggaggtccacattctgaagatgcggcacggccaggattccaacaaacaatctgcacgtccaataccagggatcgatggcgcgattgaaccgatcccctgtggttggacacagctgatccctggtttcttccccatgattactgagtcgcttttaagatggttgtgcgactgtagagccagagtgagcgtcctaggattggagggggctccccgggcagtgcagtcccgatcctgctcctgcctctgtctctgtccctcaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtcgttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaataagtctggatgaggctactcttaacgcactgcctttagggtaaccctgctctgtaggagtggttaaaaaattatttttaaaaatctagatgagtgggatggctgcaggagttggagggaaggaaagcatttgaatcctggaaagaggggagggactctagctaggtcttggggtcccagacagagaaagctgtagtcctaaaaagaggctgggttcatggtcggtgaaacaaagacagtcatagaagaggatcttagaaggatctgattccagaggagtcccagggcctgatgaacagaggagatagcgtagccatgtgcgattgtgcagatttgcagatttttttttgttcttgagatggagtttcgcgcttgttgcccaggctggaatgcaatggcgtgatcttggctcactgcaacctccgcctcctgggttcgggtgattctcctgcctcagcctcccgagtagctgggaccgcgggtgtgtgccaccacaccaggctaatttttttgtatttttttgtagagacggggttttgtctcattgcccaggctggtctcaaactcctgagcacaagcaatacgcttgccttagccacccaaagtgctggaattacatgggtgagctaccgtgtccagcctcaatttaaaaataaagagcataattgcattgtttgtaacacaaagaataaatgcttgaggggatggataccccctttaccctgtgattattatgcattgcatacctgtatcaaagtatcccataaatatatacacctactatctacccac

SEQ ID NO: 30459 - DNA, 329 bp, Homo sapiens
tttttttcaatttgagagcaggtactgtttattaactggctagattacaaaaaataattgtggtaggcatgtttattcttctaataagcctgttgatctggtcttccctgttgtcagcatctccaccttctacaaaattggtggtctttttcttcattctaacttgtcgagaggataatttgaagggccacaggaagttatttgcttctttaagcattttccaacagtatagatctcatgaatcagatcctccatgcagatgaggccatatttaccaagagatcgagcaatcaaagtattatctgttggagcaagtagcttcttattca

SEQ ID NO: 30460 - DNA, 145 bp, Homo sapiens
agaggagggaatcccacttaacgaaaacttaagtcattctcaaatttattcaaatcatacttgaaaaggcggaatgaaatttagggggatatgttttaactatataagcctttgctaataaaagattaagaagtatgtggcttag

SEQ ID NO: 30461 - DNA, 781 bp, Homo sapiens
ctggatagtaaggatgtttatcttactctgtcttcattgtcctcaaacctcaagtagtcactaataccctggctatgacagcttttatcgtagtgttaaatggcagatttatttacttggcaaacattgtcaagtctcagaaaaattaccccatggtcttgccttcttccctcgtgaattgccttccactgatggagaggatttgatctgttccctgctcatcaatttttctagcttctttggggatgtccgctctgcatatctactaaggaattaagaaataatggcttcagcaagaaacaaggcagggaaagtgccagtgacatgaggaccatacaggggaagggagctgttcccccaaaggtgagaatggccctggacaagggttcttgctgtgacttcactcaagaccagaccaccttgaccttttcgtcaccgtgcctcagcgaagtcagtcgttgattctctgatccgttacctgagatcatcatgaaatctccctcgtacgagagttgcagaactctgcagtgtcaatcatagtgtttgggagagaggactttctacctccatcctttttctgaacctaaatggaatgaaaattagaactgttgcttattctttgaggtaatttcaaattcccttatccaaaccagtgttacaaaaggactccagtttgccccccaaatcggtctattaagaatgtaatgatgaattttcatccaaatcccacaatatgagcttttctaaaataactctagaaacaaatatgacaatattccaa

SEQ ID NO: 30462 - DNA, 786 bp, Homo sapiens
ctggatagtaaggatgtttatcttactctgtcttcattgtcctcaaacctcaagtagtcactaataccctggctatgacagcttttatcgtagtgttaaatggcagatttatttacttggcaaacattgtcaagtctcagaaaaattaccccatggtcttgccttcttccctcgtgaattgccttccactgatggagaggatttgatctgttccctgctcatcaatttttctagcttctttggggatgtccgctctgcatatctactaaggaattaagaaataatggcttcagcaagaaacaaggcagggaaagtgccagtgacatgaggaccatacaggggaagggagctgttcccccaaagcagggtctttgtgacttgtaccttgtgcggacctcctactcatcctgtgactaagaacactgaacttcctggggttacagcccacaggtctcagcctcatttcatccagcccctattcaagatggagtcgctctggttcaaatgcctctgacactagtaaggatcacaggtggcatcaacaggtttggagcaaacctgagtgtctcccggttggtcacatctcaactgacgaaatccacgaccagcagagagcagcctccttgccccctgtgctcactgagtcatccagcccattttgaccaagattatgtgagttgctggagcagaggttggttgagggagctcccactgtatgtaatcaccgtgtcttgcacaaaataaatagaaaacacaagaatacactcttatgcatgatcctaaaaa

SEQ ID NO: 30463 - DNA, 729 bp, Homo sapiens
ctggatagtaaggatgtttatcttactctgtcttcattgtcctcaaacctcaagtagtcactaataccctggctatgacagcttttatcgtagtgttaaatggcagatttatttacttggcaaacattgtcaagtctcagaaaaattaccccatggtcttgccttcttccctcgtgaattgccttccactgatggagaggatttgatctgttccctgctcatcaatttttctagcttctttggggatgtccgctctgcatatctactaaggaattaagaaataatggcttcagcaagaaacaaggcagggaaagtgccagtgacatgaggaccatacaggggaagggagctgttcccccaaagcacgatgagccacttgaggccaggtacagccatggcgtgtatcccagagcacctgtgagaatgtctcacagacagtccgtctctcctgaatatgaagggatgggcaccagccggagccaccatccgtgtgactggcccgtggccgcctccagctcacacagaacctctgcacgcaacggaaaaaggtctcccctgggtgaatggggtgggaaacgtgtgcccctccaggcggctggtgagcagagtgctcccctcggcagggtgtgacttgtacagctccaccacgggccctgtaacaagacaggcttcgaccctgccctcttgcagctcgtatgtatgaggggcagcccaataaataaataagca

SEQ ID NO: 30464 - DNA, 452 bp, Homo sapiens
gaagaggccaccacaccccaggggccgggaaaggggtgacctgtgtcttgctgcttgcctagtgcttcctggatcccaggttcataccatctttgccagactggaaagaatggatgcaggctgggtgtagtggctcgtgcctgtaatcctgcactagagaggccaagacaggaggatcctttgatctcttgtttgagaccagcctgagcaacatagtgagagcttgtctctacaaaaaataaacaaaattagctgggcatggtggcgagcacctgtggtcccagctacttgggaggctgaagtgggagaatcacctgaacccaggaggtcaaggctgtggtggaccgacatcgcaccattgcactccagcctgggtgatggagcaagaccctgtctcaaaaataaataaataaataaataaataaataaataaataaataagaaagaaagaa

SEQ ID NO: 30465 - DNA, 387 bp, Homo sapiens
cgctgccacccccacagcgcgcacagtgatttcaggaaggaggtttgattggtttgttgtgtgttgccctgcaagggccccaatcagcttcctgctcatcagccccatctcaggcaagtcccacatctgtgatgtcaagccctgagccgggtaattggacttggatacctgcttgactcatctttccagtgaggttcctaaggagcatccccaaccccacctcccagggggagctctcgatgtcacctgaagaacaaacaaacaaaaactgtgttgatggtacagtcccagggctccgtgactggacaggctccctgcgtgatacacctgtgtatgtcactacagaaatacagctggtgcaggcctgtccgcctctctcacaggtca

SEQ ID NO: 30466 - DNA, 350 bp, Homo sapiens
gacactgcatggtccctgtccttgttagcggtagtgacttctgccttaactgaatttctggctacctgttagagacttccccctaaatccttcaatagccttttccataggaagacatcttgctgcaatatccctggtaaggaggtatgaagggtgctttaaatataaggaaattcatttacatacaagtgtttcattgtaatttctttcatttagatgttaattttttttcctaagctaatgtttgaattggtattaacattaaaaataaaaagttgcattaatatgcaacttttaaacatactctttatagtcattgaccatttgcaaaccaaatgcattttttatac

SEQ ID NO: 30467 - DNA, 114 bp, Homo sapiens
ggaacactgcctggtctagagtaagccctaaacaagtgcaagcaatctaataaccacctcattggtgccttctgtgggccaagcactgggttagcctcagggatttgggagggg

SEQ ID NO: 30468 - DNA, 831 bp, Homo sapiens
atatttttgaggttagagggataagtttagtaaattattattcaggagcccctacgcccttccttgcctctcttccatttaggagggttggctttgtgtttctgggtgctaaccctcctgtaagccccttataattgtagctgcccttcacagcttcacacacaggcttcacacacatgtgttagctcttccataagtgtctctgattggctggttcaatctcattgcctgggaagttaagggagtcaaaatttccacagcctcggtgcttcttattgcattgtatttttctttcaaattaatgggagaaaaagctgaataaggagtttgtgtgctttaaagtgtaccatttgttaatctggaaacctgaatgttgtgagcattggtaagtgacccatggtcacttttaaaaaataattttgtgctcatagtatggtactataccagggatttttagaacaaaaattctaattattacataactttcttattgtagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggtaagttgtgcttttgagcatgtattaccccaaaataaagcagctttactgatcaaacttgatgt

SEQ ID NO: 30469 - DNA, 3021 bp, Homo sapiens
agaggccgtggggcgggccacggtgacgcgcgcggaagcgctctgcgggccctcggaaaccgccccggcggctgagaggctgcggccactgcctggcaccccgacgggaggggctccggatcgttcggagccggctgaaccccttcggccgcgagcgaccgcatgagtcgggggactatgccccagcccgaagcgtggccaggcgcgagctgcgccgagacgccggcgcgggaggcggcggccacggcgcgggacggcgggaaggcggcggccagcgggcagccgcggcccgagatgcagtgcccggccgagcatgaggaggacatgtaccgtgctgcagatgaaatagaaaaggagaaagaattgcttatacatgaaagaggggcatcagaaccgagattaagcgtagctcctgaaatggatatcatggactactgcaaaaaagaatggagaggaaatacacagaaagcaacgtgtatgaaaatgggctatgaagaggtttctcagaagttcacctccatacggcgagtccgtggtgataattactgtgcactgagggccacgctgttccaggccatgagccaggctgtggggctgccgccctggctgcaggacccggagctcatgctggtacgttaccagaaaaactcataagcaaatacaactggatcaagcaatggaaacttggactgaaatttgatgggaagaatgaggacctggttgataaaattaaagagtcccttactctgctgaggaagaagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatatctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatcttaattaaggctattttaagcagattgttttgcaacagattaagaattgggtcccaaagtgggttatttcaaggcatttttgaagactggaggagcgtaggagggagtggtgagggaacctagaacttcttgctccttgtgactatgacagatgtctgatgcccccagcgcactggagtctggggcttggtgcaggtggtgccccatcagtgtggacagacactacttgcctttgtggtttagtgttggaagctttaattattctacagttccatagattcacaattttatagccaaacagtttgtatccacctgctttcagaggaggaaccaaaggccaaattactttgaggtagggcttagctggacctgggttttcctatgctcttttcatgctgtgttggagggtgtgtccactgccagatctgtgtaacccgtctgggtcaggggatgagtgacagcaaaccatcttaaaatttttcatgagtacatttaagcggaagcatacgggaatatgagtgcaaaagtgtggctgagccgcgtatgcccttgattggttttgggaagcctgagggaggcagccttcctggctatgagccatcgcctgcccaatcaggctaagggtggtgactggggtggtgaaggggcagctctgctgagcatggtctgccttatggcctgaattgtcctcaaggggtgtggactgcagatggtgttcacatgaaccggagacatcactctttaggattctactggcagcccctgaattggctcaacgtttgtggaggtggtatttccctgaagtactgagctttgttttataataattaaaatccttatttggtccaatttaatatagtttagaagctattttttttgaggcaaaccgtttttgaaaatgtaaattttgtttttaattaaaaataaagtcttagttaagaaaactcaggatgcacaaaactattcagactgttactttagctttctcccattacctcatcagtaatattcaccacattttgctaaatatttattgattagagtgttgaaatcaaattctgctctaaatgtgtgtgaatatgttggagaggctttgtgttcttcactgtgaaatgcaattgtgccttgaataagaaggtacctagaagccaaattaaagtaataatgacttctt

SEQ ID NO: 30470 - DNA, 4052 bp, Homo sapiens
agaggccgtggggcgggccacggtgacgcgcgcggaagcgctctgcgggccctcggaaaccgccccggcggctgagaggctgcggccactgcctggcaccccgacgggaggggctccggatcgttcggagccggctgaaccccttcggccgcgagcgaccgcatgagtcgggggactatgccccagcccgaagcgtggccaggcgcgagctgcgccgagacgccggcgcgggaggcggcggccacggcgcgggacggcgggaaggcggcggccagcgggcagccgcggcccgagatgcagtgcccggccgagcaaaccgagattaagcgtagctcctgaaatggatatcatggactactgcaaaaaagaatggagaggaaatacacagaaagcaacgtgtatgaaaatgggctatgaagaggtttctcagaagttcacctccatacggcgagtccgtggtgataattactgtgcactgagggccacgctgttccaggccatgagccaggctgtggggctgccgccctggctgcaggacccggagctcatgctggtacgttaccagaaaaactcataagcaaatacaactggatcaagcaatggaaacttggactgaaatttgatgggaagaatgaggacctggttgataaaattaaagagtcccttactctgctgaggaagaagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatatctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatcttaattaaggctattttaagcagattgttttgcaacagattaagaattgggtcccaaagtgggttatttcaaggcatttttgaagactggaggagcgtaggagggagtggtgagggaacctagaacttcttgctccttgtgactatgacagatgtctgatgcccccagcgcactggagtctggggcttggtgcaggtggtgccccatcagtgtggacagacactacttgcctttgtggtttagtgttggaagctttaattattctacagttccatagattcacaattttatagccaaacagtttgtatccacctgctttcagaggaggaaccaaaggccaaattactttgaggtagggcttagctggacctgggttttcctatgctcttttcatgctgtgttggagggtgtgtccactgccagatctgtgtaacccgtctgggtcaggggatgagtgacagcaaaccatcttaaaatttttcatgagtacatttaagcggaagcatacgggaatatgagtgcaaaagtgtggctgagccgcgtatgcccttgattggttttgggaagcctgagggaggcagccttcctggctatgagccatcgcctgcccaatcaggctaagggtggtgactggggtggtgaaggggcagctctgctgagcatggtctgccttatggcctgaattgtcctcaaggggtgtggactgcagatggtgttcacatgaaccggagacatcactctttaggattctactggcagcccctgaattggctcaacgtttgtggaggtggtatttccctgaagtactgagctttgttttataataattaaaatccttatttggtccaatttaatatagtttagaagctattttttttgaggcaaaccgtttttgaaaatgtaaattttgtttttaattaaaaataaagtcttagttaagaaaactcaggatgcacaaaactattcagactgttactttagctttctcccattacctcatcagtaatattcaccacattttgctaaatatttattgattagagtgttgaaatcaaattctgctctaaatgtgtgtgaatatgttggagaggctttgtgttcttcactgtgaaatgcaattgtgccttgaataagaaggtacctagaagccaaattaaagtaataatgacttcttattggctttgatttttcattgcagtatatgggattgtacagcaggaaatgcttatcattaatttctgatgttttttaaagcacaactcgaaacatttcgatcatacatacatagcagtagagatctgtgcccttcaggtacattgaatctgaccatcagtttatatatgtcattgaattttaagaatactcatgttaataatagtcatctatccttgcattttgaaactgttctaatcttagtgaacttgaattggatttctgggtaaaagaatgtgtttcttttatgttgcttatgtccgaaggccttgtcagaatctgtcagactcttgtttaggtttagtgtgatcatggcgtcagagaagcaaagctttcaaataaatagtacttcaggaaatagaaatgattgaccaactttaaaaataatttttttttaattgcaatatgcagcttcagttgcccagaatcttagttccgtttctcattcttggtcttgagctggtcaggtgacatcagcagattagaagttgaatggagattaagtggattcaggaggatgttccacttagagcagtcttcaaaatgataaggtgttctagaagaaaggaatgtagtaggaactatactatgcctaactttctatcccagagtgtcttgcaagagtttaggagttttggaccctgtgtattggcagaaaagttatctccatcttaagcaggcatgacttttatacctgtgagctcatttaaggtgcatttaaacctaaaataatttccctgtattatgcttcatgggattaacactgcttttccagaacattttcagattcccctccttacatcctgagctccttctgtatatacatctgttgattttatccatccacaaggaacaatgatagtcacattagagaacaagaaaccagtaatacatggtctctaactgatgattcgggcctggatttgattgaaagtgtttgcagttcctcttccgtagaatacagagtggatgaaaatgttttcaatgcacagaacaggatgaatccttttttctttatttagcgatttacacttttgttactctattatatattcagttagtgtctgata

SEQ ID NO: 30471 - DNA, 3231 bp, Homo sapiens
ggcccaaagcaggaggaaaaaacgttgtggcttcaccattgctgtgcactgtgggataatggatggaacatggtgttaagccacgtttttcagtgtgatcttcctcagaatacccgtttgctcttcttcccaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatatctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatcttaattaaggctattttaagcagattgttttgcaacagattaagaattgggtcccaaagtgggttatttcaaggcatttttgaagactggaggagcgtaggagggagtggtgagggaacctagaacttcttgctccttgtgactatgacagatgtctgatgcccccagcgcactggagtctggggcttggtgcaggtggtgccccatcagtgtggacagacactacttgcctttgtggtttagtgttggaagctttaattattctacagttccatagattcacaattttatagccaaacagtttgtatccacctgctttcagaggaggaaccaaaggccaaattactttgaggtagggcttagctggacctgggttttcctatgctcttttcatgctgtgttggagggtgtgtccactgccagatctgtgtaacccgtctgggtcaggggatgagtgacagcaaaccatcttaaaatttttcatgagtacatttaagcggaagcatacgggaatatgagtgcaaaagtgtggctgagccgcgtatgcccttgattggttttgggaagcctgagggaggcagccttcctggctatgagccatcgcctgcccaatcaggctaagggtggtgactggggtggtgaaggggcagctctgctgagcatggtctgccttatggcctgaattgtcctcaaggggtgtggactgcagatggtgttcacatgaaccggagacatcactctttaggattctactggcagcccctgaattggctcaacgtttgtggaggtggtatttccctgaagtactgagctttgttttataataattaaaatccttatttggtccaatttaatatagtttagaagctattttttttgaggcaaaccgtttttgaaaatgtaaattttgtttttaattaaaaataaagtcttagttaagaaaactcaggatgcacaaaactattcagactgttactttagctttctcccattacctcatcagtaatattcaccacattttgctaaatatttattgattagagtgttgaaatcaaattctgctctaaatgtgtgtgaatatgttggagaggctttgtgttcttcactgtgaaatgcaattgtgccttgaataagaaggtacctagaagccaaattaaagtaataatgacttcttattggctttgatttttcattgcagtatatgggattgtacagcaggaaatgcttatcattaatttctgatgttttttaaagcacaactcgaaacatttcgatcatacatacatagcagtagagatctgtgcccttcaggtacattgaatctgaccatcagtttatatatgtcattgaattttaagaatactcatgttaataatagtcatctatccttgcattttgaaactgttctaatcttagtgaacttgaattggatttctgggtaaaagaatgtgtttcttttatgttgcttatgtccgaaggccttgtcagaatctgtcagactcttgtttaggtttagtgtgatcatggcgtcagagaagcaaagctttcaaataaatagtacttcaggaaatagaaatgattgaccaactttaaaaataatttttttttaattgcaatatgcagcttcagttgcccagaatcttagttccgtttctcattcttggtcttgagctggtcaggtgacatcagcagattagaagttgaatggagattaagtggattcaggaggatgttccacttagagcagtcttcaaaatgataaggtgttctagaagaaaggaatgtagtaggaactatactatgcctaactttctatcccagagtgtcttgcaagagtttaggagttttggaccctgtgtattggcagaaaagttatctccatcttaagcaggcatgacttttatacctgtgagctcatttaaggtgcatttaaacctaaaataatttccctgtattatgcttcatgggattaacactgcttttccagaacattttcagattcccctccttacatcctgagctccttctgtatatacatctgttgattttatccatccacaaggaacaatgatagtcacattagagaacaagaaaccagtaatacatggtctctaactgatgattcgggcctggatttgattgaaagtgtttgcagttcctcttccgtagaatacagagtggatgaaaatgttttcaatgcacagaacaggatgaatccttttttctttatttagcgatttacacttttgttactctattatatattcagttagtgtctgata

SEQ ID NO: 30472 - DNA, 1384 bp, Homo sapiens
  misc_feature (1382)..(1382): n is a, c, g, or t
  misc_feature (1384)..(1384): n is a, c, g, or t
agaggccgtggggcgggccacggtgacgcgcgcggaagcgctctgcgggccctcggaaaccgccccggcggctgagaggctgcggccactgcctggcaccccgacgggaggggctccggatcgttcggagccggctgaaccccttcggccgcgagcgaccgcatgagtcgggggactatgccccagcccgaagcgtggccaggcgcgagctgcgccgagacgccggcgcgggaggcggcggccacggcgcgggacggcgggaaggcggcggccagcgggcagccgcggcccgagatgcagtgcccggccgagcaaaccgagattaagcgtagctcctgaaatggatatcatggactactgcaaaaaagaatggagaggaaatacacagaaagcaacgtgtatgaaaatgggctatgaagaggtttctcagaagttcacctccatacggcgagtccgtggtgataattactgtgcactgagggccacgctgttccaggccatgagccaggctgtggggctgccgccctggctgcaggacccggagctcatgctggtacgttaccagaaaaactcataagcaaatacaactggatcaagcaatggaaacttggactgaaatttgatgggaagaatgaggacctggttgataaaattaaagagtcccttactctgctgaggaagaagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagcaaacctgggtacgagctcgattcctggcgcgttaaaaagctgggtgggggggtnan

SEQ ID NO: 30473 - DNA, 470 bp, Homo sapiens
aaagagtttagggtcatttgaaacacagagtaaacccttcaaaatgttgtttgccagtgagtaagtgttaaaacaattgcttagaaagggacataaaactccaactttgggcatcctcccagtgatcccaggccaagctttttccacaggaatgaaactttctctgctatctcaagtcagtaacgaccattttgaattctttcataccttttcccagggctatgaagaggtttctcagaagttcacctccatacggcgagtccgtggtgataattactgtgcactgagggccacgctgttccaggccatgagccaggctgtggggctgccgccctggctgcaggacccggagctcatgctggtacgctgctgctgcaggtttgagtccaaaatgtttcaaacaatttttgtgagaaaactttccctttctgtccatgctaccttctagtatcgtctgcagtatgatgtca

SEQ ID NO: 30474 - DNA, 1576 bp, Homo sapiens
agaggccgtggggcgggccacggtgacgcgcgcggaagcgctctgcgggccctcggaaaccgccccggcggctgagaggctgcggccactgcctggcaccccgacgggaggggctccggatcgttcggagccggctgaaccccttcggccgcgagcgaccgcatgagtcgggggactatgccccagcccgaagcgtggccaggcgcgagctgcgccgagacgccggcgcgggaggcggcggccacggcgcgggacggcgggaaggcggcggccagcgggcagccgcggcccgagatgcagtgcccggccgagcatgaggaggacatgtaccgtgctgcagatgaaatagaaaaggagaaagaattgcttatacatgaaagaggggcatcagaaccgagattaagcgtagctcctgaaatggatatcatggactactgcaaaaaagaatggagaggaaatacacagaaagcaacgtgtatgaaaatgggctatgaagaggtttctcagaagttcacctccatacggcgagtccgtggtgataattactgtgcactgagggccacgctgttccaggccatgagccaggctgtggggctgccgccctggctgcaggacccggagctcatgctggtacgttaccagaaaaactcataagcaaatacaactggatcaagcaatggaaacttggactgaaatttgatgggaagaatgaggacctggttgataaaattaaagagtcccttactctgctgaggaagaagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatatctcaaatcaaaactctctctaatggt

SEQ ID NO: 30475 - DNA, 2944 bp, Homo sapiens
agaggccgtggggcgggccacggtgacgcgcgcggaagcgctctgcgggccctcggaaaccgccccggcggctgagaggctgcggccactgcctggcaccccgacgggaggggctccggatcgttcggagccggctgaaccccttcggccgcgagcgaccgcatgagtcgggggactatgccccagcccgaagcgtggccaggcgcgagctgcgccgagacgccggcgcgggaggcggcggccacggcgcgggacggcgggaaggcggcggccagcgggcagccgcggcccgagatgcagtgcccggccgagcaaaccgagattaagcgtagctcctgaaatggatatcatggactactgcaaaaaagaatggagaggaaatacacagaaagcaacgtgtatgaaaatgggctatgaagaggtttctcagaagttcacctccatacggcgagtccgtggtgataattactgtgcactgagggccacgctgttccaggccatgagccaggctgtggggctgccgccctggctgcaggacccggagctcatgctggtacgttaccagaaaaactcataagcaaatacaactggatcaagcaatggaaacttggactgaaatttgatgggaagaatgaggacctggttgataaaattaaagagtcccttactctgctgaggaagaagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatatctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatcttaattaaggctattttaagcagattgttttgcaacagattaagaattgggtcccaaagtgggttatttcaaggcatttttgaagactggaggagcgtaggagggagtggtgagggaacctagaacttcttgctccttgtgactatgacagatgtctgatgcccccagcgcactggagtctggggcttggtgcaggtggtgccccatcagtgtggacagacactacttgcctttgtggtttagtgttggaagctttaattattctacagttccatagattcacaattttatagccaaacagtttgtatccacctgctttcagaggaggaaccaaaggccaaattactttgaggtagggcttagctggacctgggttttcctatgctcttttcatgctgtgttggagggtgtgtccactgccagatctgtgtaacccgtctgggtcaggggatgagtgacagcaaaccatcttaaaatttttcatgagtacatttaagcggaagcatacgggaatatgagtgcaaaagtgtggctgagccgcgtatgcccttgattggttttgggaagcctgagggaggcagccttcctggctatgagccatcgcctgcccaatcaggctaagggtggtgactggggtggtgaaggggcagctctgctgagcatggtctgccttatggcctgaattgtcctcaaggggtgtggactgcagatggtgttcacatgaaccggagacatcactctttaggattctactggcagcccctgaattggctcaacgtttgtggaggtggtatttccctgaagtactgagctttgttttataataattaaaatccttatttggtccaatttaatatagtttagaagctattttttttgaggcaaaccgtttttgaaaatgtaaattttgtttttaattaaaaataaagtcttagttaagaaaactcaggatgcacaaaactattcagactgttactttagctttctcccattacctcatcagtaatattcaccacattttgctaaatatttattgattagagtgttgaaatcaaattctgctctaaatgtgtgtgaatatgttggagaggctttgtgttcttcactgtgaaatgcaattgtgccttgaataagaaggtacctagaagccaaattaaagtaataatgacttctt

SEQ ID NO: 30476 - DNA, 3864 bp, Homo sapiens
atatttttgaggttagagggataagtttagtaaattattattcaggagcccctacgcccttccttgcctctcttccatttaggagggttggctttgtgtttctgggtgctaaccctcctgtaagccccttataattgtagctgcccttcacagcttcacacacaggcttcacacacatgtgttagctcttccataagtgtctctgattggctggttcaatctcattgcctgggaagttaagggagtcaaaatttccacagcctcggtgcttcttattgcattgtatttttctttcaaattaatgggagaaaaagctgaataaggagtttgtgtgctttaaagtgtaccatttgttaatctggaaacctgaatgttgtgagcattggtaagtgacccatggtcacttttaaaaaataattttgtgctcatagtatggtactataccagggatttttagaacaaaaattctaattattacataactttcttattgtagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatatctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatcttaattaaggctattttaagcagattgttttgcaacagattaagaattgggtcccaaagtgggttatttcaaggcatttttgaagactggaggagcgtaggagggagtggtgagggaacctagaacttcttgctccttgtgactatgacagatgtctgatgcccccagcgcactggagtctggggcttggtgcaggtggtgccccatcagtgtggacagacactacttgcctttgtggtttagtgttggaagctttaattattctacagttccatagattcacaattttatagccaaacagtttgtatccacctgctttcagaggaggaaccaaaggccaaattactttgaggtagggcttagctggacctgggttttcctatgctcttttcatgctgtgttggagggtgtgtccactgccagatctgtgtaacccgtctgggtcaggggatgagtgacagcaaaccatcttaaaatttttcatgagtacatttaagcggaagcatacgggaatatgagtgcaaaagtgtggctgagccgcgtatgcccttgattggttttgggaagcctgagggaggcagccttcctggctatgagccatcgcctgcccaatcaggctaagggtggtgactggggtggtgaaggggcagctctgctgagcatggtctgccttatggcctgaattgtcctcaaggggtgtggactgcagatggtgttcacatgaaccggagacatcactctttaggattctactggcagcccctgaattggctcaacgtttgtggaggtggtatttccctgaagtactgagctttgttttataataattaaaatccttatttggtccaatttaatatagtttagaagctattttttttgaggcaaaccgtttttgaaaatgtaaattttgtttttaattaaaaataaagtcttagttaagaaaactcaggatgcacaaaactattcagactgttactttagctttctcccattacctcatcagtaatattcaccacattttgctaaatatttattgattagagtgttgaaatcaaattctgctctaaatgtgtgtgaatatgttggagaggctttgtgttcttcactgtgaaatgcaattgtgccttgaataagaaggtacctagaagccaaattaaagtaataatgacttcttattggctttgatttttcattgcagtatatgggattgtacagcaggaaatgcttatcattaatttctgatgttttttaaagcacaactcgaaacatttcgatcatacatacatagcagtagagatctgtgcccttcaggtacattgaatctgaccatcagtttatatatgtcattgaattttaagaatactcatgttaataatagtcatctatccttgcattttgaaactgttctaatcttagtgaacttgaattggatttctgggtaaaagaatgtgtttcttttatgttgcttatgtccgaaggccttgtcagaatctgtcagactcttgtttaggtttagtgtgatcatggcgtcagagaagcaaagctttcaaataaatagtacttcaggaaatagaaatgattgaccaactttaaaaataatttttttttaattgcaatatgcagcttcagttgcccagaatcttagttccgtttctcattcttggtcttgagctggtcaggtgacatcagcagattagaagttgaatggagattaagtggattcaggaggatgttccacttagagcagtcttcaaaatgataaggtgttctagaagaaaggaatgtagtaggaactatactatgcctaactttctatcccagagtgtcttgcaagagtttaggagttttggaccctgtgtattggcagaaaagttatctccatcttaagcaggcatgacttttatacctgtgagctcatttaaggtgcatttaaacctaaaataatttccctgtattatgcttcatgggattaacactgcttttccagaacattttcagattcccctccttacatcctgagctccttctgtatatacatctgttgattttatccatccacaaggaacaatgatagtcacattagagaacaagaaaccagtaatacatggtctctaactgatgattcgggcctggatttgattgaaagtgtttgcagttcctcttccgtagaatacagagtggatgaaaatgttttcaatgcacagaacaggatgaatccttttttctttatttagcgatttacacttttgttactctattatatattcagttagtgtctgata

SEQ ID NO: 30477 - DNA, 1057 bp, Homo sapiens
agaggccgtggggcgggccacggtgacgcgcgcggaagcgctctgcgggccctcggaaaccgccccggcggctgagaggctgcggccactgcctggcaccccgacgggaggggctccggatcgttcggagccggctgaaccccttcggccgcgagcgaccgcatgagtcgggggactatgccccagcccgaagcgtggccaggcgcgagctgcgccgagacgccggcgcgggaggcggcggccacggcgcgggacggcgggaaggcggcggccagcgggcagccgcggcccgagatgcagtgcccggccgagcatgaggaggacatgtaccgtgctgcagatgaaatagaaaaggagaaagaattgcttatacatgaaagaggggcatcagaaccgagattaagcgtagctcctgaaatggatatcatggactactgcaaaaaagaatggagaggaaatacacagaaagcaacgtgtatgaaaatgggctatgaagaggtttctcagaagttcacctccatacggcgagtccgtggtgataattactgtgcactgagggccacgctgttccaggccatgagccaggctgtggggctgccgccctggctgcaggacccggagctcatgctggtacgttaccagaaaaactcataagcaaatacaactggatcaagcaatggaaacttggactgaaatttgatgggaagaatgaggacctggttgataaaattaaagagtcccttactctgctgaggaagaaggtttggaacctgtagtgtcctgtctgataagggtgaagctctcgttcttgcttgccccagaagaccagtttttagtcttcactcagtggattttcaaatgctcttggctgatttttaggcaaaatggttttaaatgaattcaaactcttcccacgagggctttagtaaaatgggaagtaccaacattatatattcttagagcagatgccatgtactagggtatcaaataatgaagtgtttgactttcttaaaaggaaaccttaacaaatatagtctttgttccaagtcaaaaaaat

SEQ ID NO: 30478 - DNA, 582 bp, Homo sapiens
accttggggaagaggaattcaagtttctgtggcttgccttcagggagaatgaggctgagacaggagggcaggataacatcagagaaaaactttgcttctgaggccttcactttgggttttctgagccccaacatctgctagtgttgtaaagagaacaattagggaccaagtgaggggaggaaagcatccatctctgcattctgatgctgggagactatttccttgaaatgcaattgattttgcctctgctaagaggctctgctggctacccatgtactagccagtgtcctgcatgggtgctaggctgaattatttgtaattgtgcttaggtgatttgtaactcaggtatagggtatttaaatagtaggcaccctttttgcaccatgtgttttttttttttatctagttcttgtatactacagataatatttgaactttgtcatctcactgtaaaacttttgttcatttctcattatggtaataaatagctattataaccaacccatttattcaaatatgttatttccctaagtgttattttgacattttgttttggaaaaaataaatcaccatagataataa

SEQ ID NO: 30479 - DNA, 500 bp, Homo sapiens
accttggggaagaggaattcaagtttctgtggcttgccttcagggagaatgaggctgagacaggagggcaggataacatcagagaaaaactttgcttctgaggccttcactttgggttttctgagccccaacatctgctagtgttgtaaagagaacaattagggaccaagtgaggggaggaaagcatccatctctgcattctgatgctgggagactatttccttgaaatgcaattgattttgcctctgctaagaggctctgctggctacccatgtactagccagtgtcctgcatgggtgctaggctgaattatttgtaattgtgcttaggtgatttgtaactcaggtatagggtatttaaatagtaggcaccctttttgcaccatgtgttttttttttttatctagttcttgtatactacagataatatttgaactttgtcatctcactgtaaaacttttgttcatttctcattatggtaataaatagctattataacca

SEQ ID NO: 30480 - DNA, 310 bp, Homo sapiens
aagacccagatgtctgtctccaaggcttatagctactattctacagtactatcagaaaattctttaaaagaaacagtggatttatataaaaggacttttttggaaaatttggccctcctcaaagcagctgtcttcttaggaaaggtgttctaggaatacccatgcctatgtgtagctggcaaagtggtgatgtatgtcatgccctgcagatagcaatcctgcattcagagacaaaacagacagtggactgtagactttttcccgctctttgggtgcttggcataatataactgttgcaaggatatagctc

SEQ ID NO: 30481 - DNA, 180 bp, Homo sapiens
gccatagctaaactgagtccataagcacaagctgattggcctttattcaagatcacaccaagagtccctaaagtaatttaaaacttggcaaatagcacagttactaactggcaataaggaaaacacactcgctgctgtagatctccttagttgccctttatatgatatcaccttttcttc

SEQ ID NO: 30482 - DNA, 353 bp, Homo sapiens
agatcgacaaaagtcatggtgggggtgggagtaatttgatggggacaaaagtgcaataaaaataaagaaaaatcagtagctcggctgagcacggtggctcatgcctgtaatcccagcactgcaggaggccgagttgggtggatcacctgaggtcaggatttcaagacaagcctggcccaggtgtggtggcacgcacctgtagtcccagctactcgagaggctgaggcaggaggatcacctgagcctgggagacagaggttgctgtgagccaaaatcacgccactgcactccaacctggtcgacagagcgagactccatctcaaaaattttttttaagaaaaggaaaaaaaaaa

SEQ ID NO: 30483 - DNA, 472 bp, Homo sapiens
tctaatgaaaaaatcgaatgttaaaaaaccaagaaagtagaagatatttgacattaactttactaatcattgataataatctaataatcataacattattcttaaaacctgaaagaatggattcctgctcccaatgtgtttttaatatcaacttaaactaaaataatttttttacctatttttggaagcttggaaattgagatgtagttgtctaatgttaacctaattaagagagcttggtgtgatttctcatatacagcatctaaatatttaagttttaatgtcttctaaaatattattacattcttcatactatagttttttaacatcctttagaaaacttgtatcagcttcactttcaaaccatgctggcatcgaactcaggtgtagtggtatcagaatgttatgaaataattttttattttcattataaactccatttttacaataaacacttctcaaccaaaaaaaa

SEQ ID NO: 30484 - DNA, 443 bp, Homo sapiens
cccctttccccactcaggagatgtgcattcacttttaaaatagctgctgttatttagtattcatatatgtagaataggctcttaaatgcttctaataacagtatcatagaagttcacattgcctgcctggctgagtatcctaacttacagctaaagagagattgttctctagctctatttggaaataaaggatgtggtgtatgaccagatgttggaagcctcccttcttgtaatatcaaataagtataattataatatatgttaactatttacaatcactaaaatgtttcttggaaagactaggaatgactaaattagtaaactaatagaatgaaaaataaaaatggtcaaatgtatagaagcaaagagaaattgtctgaaataagatattacacattgaaatatttatagtatctattatcaaataaatgcaaatgtcaaat

SEQ ID NO: 30485 - DNA, 449 bp, Homo sapiens
gagcaactcaatcatgacatctttattataccatagatgaatatttgttaaataaaaataggtacagcaagtgtacaataagaccagtagttctccttcagaactctacccatttttcagaggaaggaaacacttttccagaatacaatgctcaagaaatgtaagccagatcccgcttgtatgaggtatcttaagtagtcagactctcaaaaacagaaagcagaataatggtgccaagagctggggcaggcagggggaaggggaaaagaggagttgttcggtgggtatagaacttcagaattacaagatgagaaagttccgggggtctgtttcacaacatgcatggagttaacactgctgtaccatatgcttaaaaatggttaagatggtacattttacctgatgtgttttttaccacaataaaaaaaataagattgaaatggattagg

SEQ ID NO: 30486 - DNA, 703 bp, Homo sapiens
gtcttaatctcctgacctcgtgatctgcccgcctcggcctcccaaagtgctgggattacacgcgtgagccaccgcgcccggcctctgatgagaatttttaaggacaatctggagggagcaaatgctctttaataatcgtcttcttcctccattgcctgggtcagccttgggtcccgtcttttatcctcagcaagaatctttcttctacttctaaattaagagtgatcacatcttaaaggagtgaagcagtgtcaagattacttaaagaaccttggtgtagtgattcagaccgggttttcagagtgagagaaacttggatctcagtaccatttctgccaattgtgggcagtgtaacgttatgcatagcttcctgaaaagccttcagttttctcttctagaaaatgtaaataatactaattaccacattgctttgttaggattcaaagggagatgtaaatcgcttagctactgctactgttctattaacaaaaatgtaatattaccttctcacatcttagctttataatatttactttctcacaccgattagcctcttcaaatttagtgacagtcctactctacttaaatcatgctaggatttttaggaattgctctactcacaatatactgagctgagatgcctgactcattggggaggggtcccctccccactctccccttttaaaattaacccaactctttc

SEQ ID NO: 30487 - DNA, 395 bp, Homo sapiens
gactttggaggttgaaggttaaaagaaaaatgtttaattaagtttcttttctgttttatgttaagttgccctgaaatatccccctgggccactgtatttgttttgacatctgatgtttgaaggagcatgtttttcccccgtagaaaatcttacataatctcaactatatcacctctgtgtgggagagataatttattcttttacttattatatattgtgtacaagttagttcttgaatgcggtcttgactacagtatatattgaatagtttatcatacgggaaatgtaaggaagccatatgtaacgtctagtatcttagatttagtcctggtctttagatgctaactttagggggaaacaaaataaacaaacctctagactaaagatttgttttt

SEQ ID NO: 30488 - DNA, 584 bp, Homo sapiens
gcaccattgcactccatactggatgacagagtgagaccccgtctcaaaaaaacaaaaaggtgggattacaggcgtgagccaccatgcccggcctagtggttagctatacattaacagccatttaccaaggaaggactggaaaagttaatcctgatgtatatcaatcactattggcagcttgatttcgttgtggagattatcaggtgacagtgttcttttttgatctttataattggtggcctagaatctgatctgtcctggttatgaacaccccagggataggatctgtaccgtccagtgtctgctgaatgggctgttttctaaccatgcctccttgcctctggagactcttgttggttggagcagtagttggcactttaatgtttctatgctgcctatgtacctcaggcagcagtcaccagtccataatttctaaacttacatagcagatcttctaatagcaaaccttaaaaagggcaagggagagaggacttaaaaatgaaagaaaaaaaaagatagggagaatgaagattttttttaaagctgttttagatcagggtaagaccaaaaaaaaaaaaaaaaaa

SEQ ID NO: 30489 - DNA, 289 bp, Homo sapiens
atttgacagataaatgtttgcaactattttcttctggcctgtggcttgcttttttattaactgtatttcagagggcagtttttaattttgatgaaatctattttatcaatttttgctgttatgatttctgcctttcttatgctgtttaagaaatctttcagctgggcaggctgggcgcggtggcccacgcctgtaatcccagcgctttgggggaggccaaggcgggcagatcacaaggtcaggaaatcgagaccatcctggctaacacggtgaaaccccatctctacta

SEQ ID NO: 30490 - DNA, 234 bp, Homo sapiens
tgtttttaagattgatatgcttgtaatatttatataggttttagttcaaataaaaatttctttaaactttttgtttctggataataagaaaaaatgagaaaatgacagactccttgtaagatttctctcacaaggtaatttgtatgctaattaaacctatttaatcattttatatgtataaatatttaaaaacaacatgtacatgataataaatatatacaaattttgtcaatt

SEQ ID NO: 30491 - DNA, 669 bp, Homo sapiens
cctgagtttttagatttcagaaagaattatgaggggttagtaattgccatatttcatttaggagaagccacaccgccttggcctcccaaagtgctgggattactggcatgagccaccgctcccagcccattttttttttttataattgaagaacttacctgacacatcattatcacccagagtccatagtttccattagggttcattcttgcacttgtgtattctgtggcttttggccaacatagaatgacagtgatccacctttgcagtgtcatacagaagagtttcactactggaaaaatcctttgtgctccccctccctccctccgcctaagtcctggcaacccctgatctttcttctgtctccagggttttggcttttcagaatgttggaatcacacagcgtatacagtaggtagcaatgttcaggttggctctttcacttagtaatgtttcctctgcatcttttcatggcttgctggttcatttctccatttttagtgctgagtaatattccattgtctggatgtcccatggtgtgtttatccagttaccccgtcagatatttttgtgtgtggctgtggcggtcagtgtgattagtcctgtcatcttgcttggaaacaaaagcctcagtgcacatgcattcttgacttttactgaagaaatgag

SEQ ID NO: 30492 - DNA, 464 bp, Homo sapiens
ttttaggtgtcttctcagccacgtgaactaggtgggactgcaaagcagcaagataggtttgcatgtgcagggcaggtcctgggactttgtagctgtagctcttattcctcttgtttttcatctttctttcacccagagcccagggcagggagaggcctgagaggatcctgtaggtgtcttcattgaggctgcagagcagaagaccaggattcccttccctccttggtcacttagcagtcagagaactttgaccagttcactcagtttctctacacctcggttacctcatttatatcacagacctcagagctccctggcccacttcatagaatggttgtaaaggcaggggcgatcacaccagctctgaggtctgtgcagattcggagcattgcagttcctctagatggccttcggaacaggctgtggagataggtgttggggtcagggcccaggcccttactgtg

SEQ ID NO: 30493 - DNA, 356 bp, Homo sapiens
tagtcttgaactcctgacctcaagtgatccacccatctcggcgtcccaaagtgctgggattacaggcgtgggccactgcgcccggccctatttttagtagagatggggttttaccatgttggccaggctggtcttgaacttttgacctcaggcgatcctcccgcctcagcctcccaaagtgctgggattacaggcgtgagccactgcacctggccaacaccttcattttaaagatccccacttcctttctttcttcctcactagccaattttgatgctaagcttagaaagctgtggtcacatgcttagttagtagcaaaggctcctgatcttcaaatttatcccatctcactttcc

SEQ ID NO: 30494 - DNA, 286 bp, Homo sapiens
tattgtaaggacaccaaaccctaaatgataaggatgttgacatcctgagtagctactttttgtgttctgtcttccatacttacatttatgcagacaagtcttagtatttttaatagttttctcagtttataatggctttaaagctatccagatgatgccagtttatccaaggaaaggacatacccaacctgaattcatacttgggttgctgtctaaaaccccaaccaaagagttaagtcatgagtactctgtccccctgccctctgctaaatgcaacaaaacatca

SEQ ID NO: 30495 - DNA, 418 bp, Homo sapiens
cagaacagccatagcaattcctgggtggtgtggagtggaaggctctggccttaactgctacacattgtctctggtaacaaggccctgcctgaagtatattccggcttctagaggttgcaaggaaatggaccactcatcagttcttgcagcctccttatgatctacagtgggacttcgcaaaggcaggcctagtaggaaaccaaagagaacagcgttggacgaagggaaggattggggctcagaaattatgagggaatggactagaccggatagaaacaaagctcttgggcaggtgtcagtggctcacacctgtaatcccagcactttgtggagggcaagatgggagaatcaattgaggtcagaagttctaggccagcctggccaacatggtgaaaccccatctctactaaaaatacaa

SEQ ID NO: 30496 - DNA, 320 bp, Homo sapiens
atcacatacataaacatctagacagaaaaagaccttagagcttttattcaaaaattttagccatgtgtcaggtacaataatgcaaactcactaatttattaaagagtatctgggctcaaattgtttttctagaccatagaacaagatttccagcacagatggctaaagcttttgactaataattattaaaaagacttttaagatttgttttcatttgtcttttttaaggaaacttttaaagaggcaaactttgatttaatttaaatgtttagatacttctatgcaccaattaaagaatgtatcacctttcttttttggca

SEQ ID NO: 30497 - DNA, 385 bp, Homo sapiens
ttttattttgagacggagttcgctctgtcccccaggctggagtgcagagtgagactccatctttaaaacaaaacaaaaaaaaaatcaacatatcatctgaatagttaaatctccaagacagccagaaactaggctagtttcagaggagaaagagtttttacatccaactcacaaattttgaaccccactgtggtataagattctcatctctgtcctttaacccaccttagaccccaagagccctggcagtgaacaccaggcctgggatgtctctaaggtaatgatggccttccaaaattttgctcttgctctgaagaagtttaccaagattctaaactagccccggcaaacagggaagtgggggtgaggagaagaagacagacgc

SEQ ID NO: 30498 - DNA, 409 bp, Homo sapiens
attacccagccttttatgttctgttccgtaacctgggaagctaacctctatgaactaaccaagattccttgttctctggcttctagatgggttcagccatggaaagcactggcagaagatcaaaggtgagggagacaggttggaatattattcctcccaaatacttctctgttaggccacagcttggaattggctgcactcttccaccaaaagttacatcttttgtcagacagccctactcctgtagttcttactaggttggtaactgcccagggcaccttgttccttcaaccttagggtgggtaacaactttgtaaccgcccaacgggtttcaccttgcccgctgcctaggacaaagctgatttatcaagacgggaattgcaatggatagagacgcagagccagctgt

SEQ ID NO: 30499 - DNA, 211 bp, Homo sapiens
ttttgtgtttcctctttaatgtctttagtcactattttataattttctttgtatagatttttcacatctttggttaaattgattcatagttattttgtgtacttgaagttattgtaaaagaaattagtttcttgatttcttttcagatatttactgctggcatatataaatgctactgatttttgttatgttgattttgtatccgtcgacg

SEQ ID NO: 30500 - DNA, 443 bp, Homo sapiens
gagttattcctaggacatgtccttttcttaggaatttaaactccatggttcaggtgaatctatgactattaatcacacaaccatttaacaaatatttattgattattccatcattcttttgttctctattgtacatgttatagatttttaagttgtctggaagtcaagatgcatatgcaagtatacaaaagggtttatatatttgtagtaagatatgtatatcatatggaatgcctataacatgaagtggaaacaattattttgttatttttttcttctatatttgggagttttttaaacttaatttttatagaaaaactaaaaatcaacccaaggtcataattctgagatctaagtagttaatacctaattgtgattattgattccaagaaataacaggagttgaaaatgtaaagtttaatttctctgattaaatttatatt

SEQ ID NO: 30501 - DNA, 512 bp, Homo sapiens
tggtggctctttccctgctgccaccaagtcatgcagagacggaggctcaggctcagttgcgttcaagattcggcttcacccgtaacccactgccatggccgaggaaggcattgctgctggaggggtaatggacattaatgctgctttacaagagctgttgaagacagccctcatccacgatggcctagcacatggaattcgcaaagctaccaaagccttagacaagcgccaagcccatctttgtgtgcttgcatccaacggtgatgagactgtgtatgtcaagttggtggaagccctttgtgctgagcaccaaatcaacctaattaaggttgatgacaaaagaaactgggggaatgggtaggtctctgtcaaattgacagagaggggaaaccccgtaaagtggttggttgcagttgtatagtagttaaggactatggcaaggagtctcaggccaagcatgtcatcagagagaacttctaatgcaagaaatgaagaaaatatctttggctcac

SEQ ID NO: 30502 - DNA, 477 bp, Homo sapiens
agtcattttgctgatgttggattgtttgctatgtgtaagaaattaggtggttacaaatgtagagaatatttttttctaaaacatgtttagaaaatataaatatttaatgtgtaattctggtttttaagaaatataaattgcaaacttcttagattttgttatagtatatgtattatagcagtttttaacctaatgtaaaaataacctagagattccagtcttggaacctgtgctatacataagaaatgtagctggctaggcacagtggctcacgcctgtaattccagcactttgagaggccaaggcaggcatcacaaggtgaggagttcgagaccagcctaacatggtgaaaccctgtctctactaaaaatacaaaaattagtcgagcgtggtggctcatgcttgtaatcccagctactcgggaggctgaggcaggagaattgcttaaacctgggaggcggtggttgcggtgagcta

SEQ ID NO: 30503 - DNA, 567 bp, Homo sapiens
gatagacaaacaccagttccaagtcctcaggccccagaaacctctcaggacccaatctcatttgttcaactccaagtcaaccatgacccatggaaagctcatgaatccgtggtggccagcaggcaagaaacaatgttgctatatactggtgtttgccatcggtggaaattcatactacggaatgatctcatccgtgtgcatctgctccagctgccctaacaaagtagcacactggggccttaaacaacagagatgcaattcctcacagttccggaggcgggaagtccgagatcacagtgttggcaggtctgattcctcccaaggcctctctccctggactgcagaggctgattcctacctttgtccacacatggtcgtccctttgtgtgtgtctgtgtcctaatctctattcttacaaggacaccagtcacagcagattagggcccaccctgatgacctcattttaatttaatgaacctctttttttttaatcggcatacattacttatttttattaatgtaaaataaaatatattaacattctattcgctacatgtcaaaacacaa

SEQ ID NO: 30504 - DNA, 312 bp, Homo sapiens
gtttactaaaaaagcaaaactggcacatggacgtgtcaattgccttaaactgccggattcaatctgccaatgtcaatcaaaggtctctacattgtacactttctttgagatatcaattttgtttagagaattttctctttgggaaataatgaatgatttgtgattggatttagctacagatgttttctggtagcattttaataataaatacctgtaaataactgaagtagccaacattgtatcacggctataaaaaaaaacctaagataatctgcataatgaaataaaacttcaatgcatattatgttttaa

SEQ ID NO: 30505 - DNA, 673 bp, Homo sapiens
ataacctactcaatctcctcagctgagccctgcacagccgaaaaaaggggttcaggctgcttcatgctgactgatatcgggtgagcctctctatacggaggtgaggataaaaatcaggagcagaacagggcatgaggtgagctgtcctcgtgtgtacaaaacagggcagatatgtgtttgccggtatgtgctggaaggagctaggagggtgcgtttcactgcagaccgtgttaacacagctaaaaagcaaacaaaaactgggcaacatagtgagtatacaaaaaatacaaaaaaatgaactgggtgtgatggctggtgcctgtagacccaggaactcaggaggctgaggtgggaggatcattgcagcccaagaaggcaagtctgcagtgaggtatgattgcgtcactgcagtccagcctgggtgacagagcgagaccttatctcaaaacaagcaaagaaacaaacaaaaaggcgccggcgtctttgaaataacccaaaagcgaagtgggaagagaatacaggcaggaggccgggtgggtgcggtggctcacgtctgtaatctcagcactttgggaggccgacgcgggtggatcacctgaggtcaggagttcgagaccagcctgaccactatggtgaaaccccgtctctactaaaaatacaaaaattagccagg

SEQ ID NO: 30506 - DNA, 568 bp, Homo sapiens
ataacctactcaatctcctcagctgagccctgcacagccgaaaaaaggggttcaggctgcttcatgctgactgatatcgggtgagcctctctatacggaggtgaggataaaaatcaggagcagaacagggcatgaggtgagctgtcctcgtgtgtacaaaacagggcagatatgtgtttgccggtatgtgctggaaggagctaggagggtgcgtttcactgcagaccgtgttaacacagctaaaaagcaaacaaaaactgggcaacatagtgagtatacaaaaaatacaaaaaaatgaactgggtgtgatggctggtgcctgtagacccaggaactcaggaggctgaggtgggaggatcattgcagcccaagaaggcaagtctgcagtgaggtatgattgcgtcactgcagtccagcctgggtgacagagcgagaccttatctcaaaacaagcaaagaaacaaacaaaaaggcgccggcgtctttgaaataacccaaaagcgaagtgggaagagaatacaggcaggattacaggcgtgagccaccacgcctggcctataagatacggt

SEQ ID NO: 30507 - DNA, 1291 bp, Homo sapiens
tgaaaaattttacagttaaaggaacattagtgttgcatttgcaataactaggacaagagccagtcacatgctgatcttttaagtaatgagaatactaagtaaattaacaccataacatagatttaaagaaaaaaagccattagaactaaattaatataataacgtccagttacagcctctggttctgcttaaaatttatcagattctatttacacgtagggaaaaggacataaaatgaatcttagccttgaatatattcatacttaattaacgcatcctaaaaaaccattaacttaaacatcttaaagtgttctataatgttggctttatatgttttaaagtaagaaactttctgccagtggctttctttcttttttttttttttttttaaagagaaagcatcttgttctgttgcccaagctggaatgcaagagcagagtaacagctcactgcagccactgcagccttgatcccctcacttcagcctcccgagcagctacaatcacaagcacgggccaccaaggccggctaacctttatttcttgtagacatggggtcttgctatgttgcccaggctggtctcaaactcccgtcctcaagcaatccacctgattacaggcatgagccactgcaactagcccagtggcttaatttctgcttagaaaaatataatacctatcatacttaataaacagatagcttaaaagcactgttctaataagagaatttaacatacaaaaacagtattcattttggtttatactcttaaaagattaaatattctggttgtatttaaaaataaatttttaaactttcatgaaagaatgtacggccaggcatggtggctcacgcctgtaatcccagcaccttgagaggccaaagtgggtggatcacctgaggtcgggagttcaagaccagcctgaccaacatgaagaaacctcatctctattaaaaatacaaaaaattagctgggactacaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaatac

SEQ ID NO: 30508 - DNA, 294 bp, Homo sapiens
gagcttttagtatggctgaaattgaatctcttattcccctttctccaaaattgtacactttccatatgccccttatctcagtgtcaccaatatctacccagacttctaagtcagacatgaaatcatcgtgacatttcccgctccttcattcttacatccaattaatcaccaagtcccagagaatttactgcctgaaaccttcaccatcctgttcacttttttctgtcctacccatattccttagttcttcacatagttattgaaataacttcttgactggtttctctgtttatc

SEQ ID NO: 30509 - DNA, 318 bp, Homo sapiens
taaagtgatgacaccatgttggagatgtctttcgtaagtctggcataacttttttccctcaagcactggaacagatcactgtatctttgcattgaaacaaagcaaagcaatttgcttttatttaagggccatgttacatacaacttactcatctttaaccattagaatcacacttttcattgagaggtatgcggtttgagagctgaaaccaaatgagatgactagagatttacatcttgcatctcatgctctctacaaggctcactgtggcttagtggtggcatgttggtttgcagaatcttttgcactaattgtttt

SEQ ID NO: 30510 - DNA, 288 bp, Homo sapiens
tacagtattttcccccctgttaaacagctattttttacacatctgtttggcccttttgcacgacatgcagtcaggaggtgtaacgaatacaggtttgaaacaacatgtggccaccatttctttcagtttcatcttcaaggggatctcttgaaagttgtgatatcattttcatcacagtacaagtgaagtatgttaatggctagttatctgacactgggtgttgactgatgagtcataaatatgccttctggtggtaggaaagcatgatgacaaagctaagtaatgaaa

SEQ ID NO: 30511 - DNA, 967 bp, Homo sapiens
tgaaacggaaatatgttggggacggaacaactgcttcctttgaatctcttcgggtgctaatcaaatggccgctgtaagggatctccacaaagccacgaagaagccaggcctttccgagactgtaaccgctgtgcagatagcgccgatccctgggtggccgctctctcgttctgcgcgtgcgctcgttctgggctgggagcggatgggtgctgaggcgtgtgacgtctctagtagtgtcgtaactgggtgtgctgccttttccaggtgtactgaggtcttcgtgagattcagggctaggactcgtgtggctgtgtcatgttccgaatgaagcttaaaaggtgatctttgagaactgaagacttgagacccctccatgggcccaggggctgccaacactaataatttcagagacttagaatctgaggagaatctccaatctaaggggaaacggaagagggtcaggaaagagaaggggcaagcttaagtgactcagaatccaagaagcaagtctcataggagagctgcgatcgaggttaccatacagtatccaatcgtctcaaccttcccatccatacttccatgctgtctttcctctgaatgcaaggaaaaccggttacacaaacgctgacaaaagaatgtcagacttgaatggaaattcggagcagtacccatctggtccatacagcgaactcccagtgagcaccacggcaatgtaactaattcatgtttccctcttggcagtgcgggaaaggcagcaaagagccaagttttgtatcttaacagttctttagttaagaggcacacgctattttgcattcttccctacttttgataatttttggctgcactagtaatgcatgagtatctgctcatttaaaaaactcaaactttttcagtgaaaagtatgcccttttcttcagaaagtcttaattaaaaaaaaaaatcattgcccagaccaacattttca

SEQ ID NO: 30512 - DNA, 986 bp, Homo sapiens
taaggcaggcagtctactttccaggggtgagcaagccccagacggtatctcctggatgccagtgagcggctgagagctgaagctccctggacactcaaggctcttgtggtgacagtctgacgtaaaggcgtgcagggaggcctagctctgtctcctggacttagagatttcagacacagaagtctgtccatggctccttgtcacatccgcaaataccaggagagcgaccgccagtgggttgtgggcttgctctcccgggggatggccgagcatgccccagccaccttccggcaattgctgaagctgcctcgaaccctcatactcttacttggggggcccctcgccctactcctggtctctggatcctggcttctagccctcgtgttcagcatcagcctcttccctgccctgtggttccttgccaaaaaaccctggacggagtatgtggacatgacattgtgcacagacatgtctgacattaccaaatcctacctgagtgagcgtggctcctgcttctgggtggctgagtctgaagagaaggtggtgggcatggtaggagctctgcctgttgatgatcccaccttgagggagaagcggttgcagctgtttcatctctttgtggacagtgagcaccgtcgtcaggggatagcaaaagccctggtcaggactgtcctccagtttgcccgggaccagggctacagtgaagttatcctggacaccggcaccatccagctctctgctatggccctctaccagagcatgggcttcaagaagacgggccagtccttcttctgtgtgtgggccaggctagtggctcttcatacagttcatttcatctaccacctcccttcttctaaggtagggagtctgtgatctctttctgtgtgtattggtcagaatagaatccattcagctgtagcagcaagcaatccccaacctttcactgcaatgacctttcaatgcaataaaagcttattgtccattca

SEQ ID NO: 30513 - DNA, 1039 bp, Homo sapiens
taaggcaggcagtctactttccaggggtgagcaagccccagacggtatctcctggatgccagtgagcggctgagagctgaagctccctggacactcaaggctcttgtggtgacagtctgacgtaaaggcgtgcagggaggcctagctctgtctcctggacttagagatttcagacacagaagtctgtccatggctccttgtcacatccgcaaataccaggagagcgaccgccagtgggttgtgggcttgctctcccgggggatggccgagcatgccccagccaccttccggcaattgctgaagctgcctcgaaccctcatactcttacttggggggcccctcgccctactcctggtctctggatcctggcttctagccctcgtgttcagcatcagcctcttccctgccctgtggttccttgccaaaaaaccctggacggagtatgtggacatgacattgtgcacagacatgtctgacattaccaaatcctacctgagtgagcgtggctcctgcttctgggtggctgagtctgaagagaaggtggtgggcatggtaggagctctgcctgttgatgatcccaccttgagggagaagcggttgcagctgtttcatctctttgtggacagtgagcaccgtcgtcaggggatagcaaaagccctggtcaggactgtcctccagtttgcccgggaccagggctacagtgaagttatcctggacaccggcaccatccagctctctgctatggccctctaccagagcatgggcttcaagaagacgggccagtccttcttctgtgtgtgggccaggctagtggctcttcatacagttcatttcatctaccacctcccttcttctaaggtagggagtctgtgatctctttctgtgtgtattggtcagaatagaatccattcagctgtagcagcaagcaatccccaacctttcactgcaatgacctttcaatgcaataaaagcttattgtccattcactccaaatcaacgtaacaccaaaacaaagggagggccaccaaaaatacccgga

SEQ ID NO: 30514 - DNA, 947 bp, Homo sapiens
ccttgagcaggtctccctgttcctgcaaggctgggagccatgcaggcactcacatgattttctctctcttccccagtctgacgtaaaggcgtgcagggaggcctagctctgtctcctggacttagagatttcagacacagaagtctgtccatggctccttgtcacatccgcaaataccaggagagcgaccgccagtgggttgtgggcttgctctcccgggggatggccgagcatgccccagccaccttccggcaattgctgaagctgcctcgaaccctcatactcttacttggggggcccctcgccctactcctggtctctggatcctggcttctagccctcgtgttcagcatcagcctcttccctgccctgtggttccttgccaaaaaaccctggacggagtatgtggacatgacattgtgcacagacatgtctgacattaccaaatcctacctgagtgagcgtggctcctgcttctgggtggctgagtctgaagagaaggtggtgggcatggtaggagctctgcctgttgatgatcccaccttgagggagaagcggttgcagctgtttcatctctttgtggacagtgagcaccgtcgtcaggggatagcaaaagccctggtcaggactgtcctccagtttgcccgggaccagggctacagtgaagttatcctggacaccggcaccatccagctctctgctatggccctctaccagagcatgggcttcaagaagacgggccagtccttcttctgtgtgtgggccaggctagtggctcttcatacagttcatttcatctaccacctcccttcttctaaggtagggagtctgtgatctctttctgtgtgtattggtcagaatagaatccattcagctgtagcagcaagcaatccccaacctttcactgcaatgacctttcaatgcaataaaagcttattgtccattca

SEQ ID NO: 30515 - DNA, 378 bp, Homo sapiens
taaggcaggcagtctactttccaggggtgagcaagccccagacggtatctcctggatgccagtgagcggctgagagctgaagctccctggacactcaaggctcttgtggtgacaggtgaggggactgggtggaaggacagtgctctgagcatgcaccttccttgggatctggaggctgggctgttttttatgcttggctcttatgccacttcagcaacctaaaaacttacaataaagctggagggagcctttcctgaaacttgtgttggacagagaatttttgcgatgtatggtccctggagaaggacaaaagggttgcacgtgtggcctgcctgaggtaggtgccccctcaatgcacggagaagctgagagagccag

SEQ ID NO: 30516 - DNA, 1047 bp, Homo sapiens
taaggcaggcagtctactttccaggggtgagcaagccccagacggtatctcctggatgccagtgagcggctgagagctgaagctccctggacactcaaggctcttgtggtgacagtctgacgtaaaggcgtgcagggaggcctagctctgtctcctggacttagagatttcagacacagaagtctgtccatggctccttgtcacatccgcaaataccaggagagcgaccgccagtgggttgtgggcttgctctcccgggggatggccgagcatgccccagccaccttccggcaattgctgaagctgcctcgaaccctcatactcttacttggggggcccctcgccctactcctggtctctggatcctggcttctagccctcgtgttcagcatcagcctcttccctgccctgtggttccttgccaaaaaaccctggacggagtatgtggacatgacattgtgcacagacatgtctgacattaccaaatcctacctgagtgagcgtggctcctgcttctgggtggctgagtctgaagagaaggtggtgggcatggtaggagctctgcctgttgatgatcccaccttgagggagaagcggttgcagctgtttcatctctttgtggacagtgagcaccgtcgtcaggggatagcaaaagccctggtcaggactgtcctccagtttgcccgggaccagggctacagtgaagttatcctggacaccggcaccatccagctctctgctatggccctctaccagagcatgggcttcaagaagacgggccagtccttcttctgtgtgtgggccaggctagtggctcttcatacagttcatttcatctaccacctcccttcttctaaggtagggagtctgtgatctctttctgtgtgtattggtcagaatagaatccattcagctgtagcagcaagcaatccccaacctttcactgcaatgacctttcaatgcaataaaagcttattgtccattcaaaaaacaaactaaaagaagaaaaaggggggcgtcggggtaacccacgggggcccattggac

SEQ ID NO: 30517 - DNA, 708 bp, Homo sapiens
atgcaagcatgtggggagggtgaagaaaaagacgcaaagatgttgtattcagtccagttgacggcttccagggaatggaaaaaggaaaggaccccatgagccagccaacaggtaccactgccgaaatctctgctggaggatggcctttggaacacgtgcttatgctgtgattggaggccagtggtgtgatgagcaccttttaagagtttgggagcagagggaaaatttctccaaaagccacccaagccaggcttctgacctgaagcccagtatgtgtcaccccctctctgagctcagaactacaaaggctgactggcattctccaacccgcccagctcctttcaaacccacagactgtgccagactggccccacctcccactgcagcaaatgctgtagccccgctccatgctgtgttgtaaggagccagacttccgttttaattgtcctacctggccgtcccctctgccactacccctggctcttggttcctggcatggtttcaaaggcccaatcaatggctttccctcccccatcggaatcttaaacactgctagttctcccttttccaaattttatctctttcaaacttaaatgtttttatgtcttgtactttgtttcatgtctagccaccaccacctcgtttctttggccactctcattctcttgtttgacacttttttttgccatgtcttttctcatattagga

SEQ ID NO: 30518 - DNA, 192 bp, Homo sapiens
catgagccactgcactgggcctaggggtccatttttaattatgaacagataaccaaggtttagcagacacctgaagaaaatagagaccaacaagaagagaccgctacagagaaaccaactatacaaagaaaagaaaacaaaaacaaacaaacaaaaaactacctaatctatcaaaaaaataagatagtacat

SEQ ID NO: 30519 - DNA, 385 bp, Homo sapiens
gtcttgaatgttatttatttgcatatgagtgatatttcagtttgtggctgatacccttttggtattaaatggaagatgacaaatcattcaatattaattttagagggagacatctattgaaacttttgtgcagtcaggtcaagtttctgtgtacaaaaattagcagagaggttgctgctggttgacttcccctaggatggtgtctttctgaacattttgaaatgtagattgaaaaggtggatttgtcaactaactctgaagtgctgtagttagttgtgttttcatcattgttttattatttattttatttttaagatggagttttcgctcttgttgcccaggctggagtgcagttggtgcgatcttggctcactgcaacctctgc

SEQ ID NO: 30520 - DNA, 453 bp, Homo sapiens
tggcatgaaaattttcgattaatggaatctgattcagtcttttaaaacattacttggaggggtattttaaagatctcaagtatccatgctattgctgcccctccactgcatgaacaattgagagcacgtgggaggcagaatgaaaatggcaatattccagttctcttgctcaagttctcatgggtacagatgttcctaattcagtgtgtgggaccaacgtttccccgccccttctataatttcaaacaaaggctttatcccagatgattagagattcatgagttatctacttttctctctcattctataagtcttctattcaacatgtacggctagataaaaaggaagggaaaaatgattcgaatatggattaaaaatacgacaaccatattcttggtcacagctcctatttcgggacagatgcacattccaaaactattaagtaacccccta

SEQ ID NO: 30521 - DNA, 635 bp, Homo sapiens
tttttgtattttagtagagacggggtttcaccatgttgcccaggctggtctccaactcctgagctcaggcaatccgcctgcctcagcttcctgaagtgctaggattacaggcgtgagccatggcgcctggccaacttcattttttatttttttggaaagtgtacgtgacttcatattcatccatttggaagtgtacaattcagtgcattacatgtattcacagtgttatataatcattttctataccaaagtttttcaatatccccaacataaactatccattaaatagtaattcctaatagttccctattcctactccttggtaacctaaattctttctctccctttgaatttgcctgttttattttagataatataagtagtatcatataatatttatctgtttatatctggcttattaacataaagtggagccaattttagcacatttttgtcacttcaaaatgaaaccttcttgcttgataatttaccatgttaaaaaaaaaaaaaaaggaaaccgggcggggcgtggtggctcaggcctgtaatcccaggactttgggaggccgaggtggacagatcacaaggtcaagagattgagaccgtcctggccaacgtggtgaaaccgtctctaa

SEQ ID NO: 30522 - DNA, 983 bp, Homo sapiens
ttttagtagagatgggttttgcaatgttggccaggctggtctcaaactcctgacctcaagtgatctgcctgcctcggcctctcaaattgctggaattacagttgtgagccaccacacctggcttgaatgtagattttaataattgaatttattctgccgtgttgatagaataactgaatatcagtaaattgtgtaacagtggtggatactgttgcataagatgagctcctgaagagtgaagctaattctttggtcaatgttcttttcccctcagtgtctagtttaaggcttttagaagattgatctgtagcaattatttaatgaattgaatatttaaaaaattttttatttgctgtctttggtaattatctctctgcttgaaattaaatgcactataagttaatataacaagtaaaatacattgtcttttgaaaatagtttctttttaaaggaatactaattaattgtaacttgtaaaaccaaaagttctaatggtttttaaaaaccagtgttgagtggaaaagtgtttctttagtttggaaagacctgtgaagtatcctagtcagggaaagaacctgttttctggaagaatgtaagttgctatatgtggaggggcatgtaggacaggggttctaattactgtctgtgagagttactactttgtaacttatggtttctgcttcagtattgtgttggttctgtattataaattgcaccttaatagaccaaaaatatctatacagcactgatttccttgaatattgtgtgttaattgatatatcttctagaggcaaaaggtttaaatgtgttaaaatggttatattgcctcctttttaaacaaattaaagagttgtaaatactagtgtagatctcttttgtttaccacagcaaatactgattttatgattgttaagcatttcatattttaatttaaattggattcaaccacaataaagaaaatgagaaaagctttaaaaaaaaca

SEQ ID NO: 30523 - DNA, 805 bp, Homo sapiens
ttttagtagagatgggttttgcaatgttggccaggctggtctcaaactcctgacctcaagtgatctgcctgcctcggcctctcaaattgctggaattacagttgtgagccaccacacctggcttgaatgtagattttaataattgaatttattctgccgtgttgatagaataactgaatatcagtaaattgtgtaacagtggtggatactgttgcataagatgagctcctgaagagtgaagctaattctttggtcaatgttcttttcccctcagtgtctagtttaaggcttttagaagattgatctgtagcaattatttaatgaattgaatatttaaaaaattttttatttgctgtctttggtaattatctctctgcttgaaattaaatgcactataagttaatataacaagtaaaatacattgtcttttgaaaatagtttctttttaaaggaatactaattaattgtaacttgtaaaaccaaaagttctaatggtttttaaaaaccagtgttgagtggaaaagtgtttctttagtttggaaagacctgtgaagtatcctagtcagggaaagaacctgttttctggaagaatgtaagttgctatatgtggaggggcatgtaggacaggggttctaattactgtctgtgagagttactactttgtaacttatggtttctgcttcagtatagatatgtcggtatagataggtcagtatagataggtcagtatagataagtagtatagataggtcagtatagataagtagtatagataggtcagtatagataggtcagtatagatagg

SEQ ID NO: 30524 - DNA, 139 bp, Homo sapiens
gtaggtaagcaagtccttgttccacacccaacacattctcctcactaaacctgccagtccttttgctgtgcattttcatctttcttttcttttcttttctttttttgacacagggtttcactctgttgctgctggggtg

SEQ ID NO: 30525 - DNA, 329 bp, Homo sapiens
gaaaacaaagaccccatctctacgaaaacatagatagatagatagatagatagatagatagatagatagatagatagatagatagatagagataaagatagatgatggagattagatagttttaaacagacattaatgagtctggaccttggaaaaaacttatgcaactttaggaacataacatcacacagtcatgggaaattttggtgaagaaaaggggagatgaccgttcatccggaattgtttagctaaattcttccccaggaaactcttcagagattatgtgatctttacaaattttttttagctcaaggtaggattgtagaata

SEQ ID NO: 30526 - DNA, 324 bp, Homo sapiens
aaaaaaatcagtaaacttgaagatagaatagaaattacgcaaattgaaccaacagggataaaacctcacccgaaaaatatatatcagtccttatgggacatgtgagactatagcagatcctaatattcatgttgttaaagtcaagaaggaaaagacaaagagggtggggctgaaaaagtattcatagaattaatagccgaaatgttcccaaatttgccaaacaacataaacatacagattcaagctgagaaaaccctaaatgggataaacccaaagaaatccatgccaagatatattacaaactgaaaactgcaggccaaagga

SEQ ID NO: 30527 - DNA, 441 bp, Homo sapiens
ctactactactaaattcgcggctgctcgaccggaatctctggatagtgtcaaccctacccattccaggaaaaagggacctagtcagctagtaaaatctgggcatgatgacctgtcttctctctggtacttggaatgggtatctaaactcactaagcaggcactcataggtgctctcaggtatgtgagatcctatcttcttttggcagtcgggaaattagtagtgctatgtttttgtttttgttttgttttttcactattgtgatttaagctgttaggaaatttgagatcagctagggattctaagtgatgatcatcttacatggagataaataaatgtcccttccatcaggactgcatttgatgggttgaaaattattgggcatcaattacaatgacaaagataatgtatcagtgtatgtgggagctctccctcacatggc

SEQ ID NO: 30528 - DNA, 354 bp, Homo sapiens
gttttatggtactatagtgggtttctggggtatggaacacactcccagttagctctgatattggctggatgagccacactgcatgctgaagtgtggattccccatcgcctttcatgatttttcataagggtttggaaataaggaaaaagtgtggtttattttaccaagtattatgggaaagaacatagacacaaattggcaaaattaatactacacagggaccctaggaagtaccctttgagcctaaagagagttttccaaggtgaggccagttatctgagcagatcagggaatgggaagcattgcagttatttttatttgacccctttttctaatcacatctttcttcgtgag

SEQ ID NO: 30529 - DNA, 669 bp, Homo sapiens
tttttttttgtaaagacagggtctcaccatattgctcaaactggtctcgaactcctggcctcgagtgatcctcccgcctcagcctcccaaagtgctggggttacatgtgagccactgtgtcagccactgtgtctggcctgtccacccatctgatcccttctctctggcctcaggaaaacagcactctggcaaactccttcctcctttcatgactctcccaagcacctccctgagctgtcggtttcatacttggcttcttagtcttagcaataaataggatcaagtttcttctgtcctaaaaaaaaagtcttccttcatccccatctcctcctgaggccacctccttaccccgaccacctgccattgggccacgtcctcaagccctccagggcatcccgctccgttcatcagtgacctccctgagcccagcccgatgacgtcttcccttgtgcctccctgcccatgacctgttgcctggacccacatggctggccaaggcctccctggaatctgcaatctcccgcacggtctcctctgacgtcttggacactgacagtcctctgcttcctgtggtggctgctcttctcctccccagcgtaggcagctctcaaggggtcgtctctcatctcctattacaccctctccccagatgctcactcctgggcttcc

SEQ ID NO: 30530 - DNA, 1969 bp, Homo sapiens
agaaatctcctaaagccagagcctgtgctgtgaggggcttcgggaccttggggcagctcctgagttcagacagagttcaggaagggagacaggggcacagagagacagaggttcatggactgaggcaaaggctgggccaggctcagcaacccaggcctcccgcaggcaggcagaggctgccctgtaacccatggagaccagaccaacagctctgatgagctccacagtggctgcagctgcgcctgcagctggggctgcctccaggaaggagtctccaggcagatggggcctgggggaggatcccacaggcgtgagcccctcgctccagtgccgcgtgtgcggagacagcagcagcgggaagcactatggcatctatgcctgcaacggctgcagcggcttcttcaagaggagcgtacggcggaggctcatctacaggtgccaggtgggggcagggatgtgccccgtggacaaggcccaccgcaaccagtgccaggcctgccggctgaagaagtgcctgcaggcggggatgaaccaggacgccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatgctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggaccccacggagtttgcctgcatgaaggccttggtcctcttcaagccagagacgcggggcctgaaggatcctgagcacgtagaggccttgcaggaccagtcccaagtgatgctgagccagcacagcaaggcccaccaccccagccagcccgtgaggtttgggaaattgctcctgctcctcccgtctttgaggtttatcactgcggaacgcatcgagctcctctttttccgcaagaccatagggaatactccaatggagaagctcctttgtgatatgttcaaaaactagtgggggtggaggtgaaatgtttccaagcactctggaaaacaatctactgaaacgaaacatttgcctactctttgccccagcaattcctcgtaggtgtgtgtacccagcagaaatgcccaccgaaagatattgtaagaatattcatagcagctttattcataatagccccaaactgtatattgatggtaggatgaattaacaagttgtggtatattcatataatgaaaaataatttaaaaagaatgaattacggatacatgtggcaacacaggtaaacttcacagacataaaagttgaatgaaagaagccaggccgaagttccatttatgcagagttcaggaacaggcaagactaattgacaataatagaagttggaatagtggttacttctgggtggtgggggattgatacagagggggctcatgggagccctctggtgtaccagaaatgttgattttgatctgggcagtggtttcacaaatgtattcatacgtaataattcattgagctgtgcactttattttgttagacctcaataaaaaagtt

SEQ ID NO: 30531 - DNA, 2102 bp, Homo sapiens
agaaatctcctaaagccagagcctgtgctgtgaggggcttcgggaccttggggcagctcctgagttcagacagagttcaggaagggagacaggggcacagagagacagaggttcatggactgaggcaaaggctgggccaggctcagcaacccaggcctcccgcaggcaggcagaggctgccctgtaacccatggagaccagaccaacagctctgatgagctccacagtggctgcagctgcgcctgcagctggggctgcctccaggaaggagtctccaggcagatggggcctgggggaggatcccacaggcgtgagcccctcgctccagtgccgcgtgtgcggagacagcagcagcgggaagcactatggcatctatgcctgcaacggctgcagcggcttcttcaagaggagcgtacggcggaggctcatctacaggtgccaggtgggggcagggatgtgccccgtggacaaggcccaccgcaaccagtgccaggcctgccggctgaagaagtgcctgcaggcggggatgaaccaggacgccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatgctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggaccccacggagtttgcctgcatgaaggccttggtcctcttcaagccagagacgcggggcctgaaggatcctgagcacgtagaggccttgcaggaccagtcccaagtgatgctgagccagcacagcaaggcccaccaccccagccagcccgtgaggtgacctgagcatgcgcccacccactcatctgtccctgacctctaacctttctctgcctctcccacactctcccagagctcactgattagacagcacaagggtctcagttcaacagcatacagccaacatctatggtgtcccaggcacagtgccaggccccgggagtggggaccaagatgtacataagacaaagctactgccttctagagacaaccggcagtgacctcactgaagacaaaaactgccctagccaggtactgagggttgcatgaatctgcaggagacagagatccccttgcatgggaaacataaagcagaattgggagggactttgtggagacagggctggacttgaaaggaagaagaagtctaaaagaaaacatcatttgcaaagggagagaggggcaagcatgatatgttgttagaacaggagcccactttgaaggtataacaggttcctgccagtgagaaatggggagaataagccagaaaagtaccctaggaccagcccgttcaggactttgaatgccagccaaaggccacgtctgacttgggaggcagagggcagctactgcaggtttccgagcagagggtcatacacagggctggacctcacgcagactggcatggccatgggtccagaggatactactgggaaggggatggcagctactgccaccttccagatggttccatggagttctgatctttgggcatggccaggggaagcagaagggagactctaggagttgaaatgggtcagacccggtgtttgggtgaaggtaaggaatgagggaagaggagctctttg

SEQ ID NO: 30532 - DNA, 1984 bp, Homo sapiens
tattgctttaattgcaacaagctgagctaatgtgggaagaatgcagtagagtggcacagaagaatgctaacccgaaactctaagcctgttccctggaatcttccatctggatggaggagagaaagttgacctggagtgaggttcaatgtaaggacaagatctgcacccggagaagctctctctcggagagcacaggcggcctgaggagtcaaaacaggtggcctgtggagtcagcacaggcagcctggaggaggtgaggaactgaagtttggacagattgagtcactttctcagggacacatggctggccggtgatggagaaggcgtgagcccctcgctccagtgccgcgtgtgcggagacagcagcagcgggaagcactatggcatctatgcctgcaacggctgcagcggcttcttcaagaggagcgtacggcggaggctcatctacaggtgccaggtgggggcagggatgtgccccgtggacaaggcccaccgcaaccagtgccaggcctgccggctgaagaagtgcctgcaggcggggatgaaccaggacgccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatgctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggaccccacggagtttgcctgcatgaaggccttggtcctcttcaagccagagacgcggggcctgaaggatcctgagcacgtagaggccttgcaggaccagtcccaagtgatgctgagccagcacagcaaggcccaccaccccagccagcccgtgaggtttgggaaattgctcctgctcctcccgtctttgaggtttatcactgcggaacgcatcgagctcctctttttccgcaagaccatagggaatactccaatggagaagctcctttgtgatatgttcaaaaactagtgggggtggaggtgaaatgtttccaagcactctggaaaacaatctactgaaacgaaacatttgcctactctttgccccagcaattcctcgtaggtgtgtgtacccagcagaaatgcccaccgaaagatattgtaagaatattcatagcagctttattcataatagccccaaactgtatattgatggtaggatgaattaacaagttgtggtatattcatataatgaaaaataatttaaaaagaatgaattacggatacatgtggcaacacaggtaaacttcacagacataaaagttgaatgaaagaagccaggccgaagttccatttatgcagagttcaggaacaggcaagactaattgacaataatagaagttggaatagtggttacttctgggtggtgggggattgatacagagggggctcatgggagccctctggtgtaccagaaatgttgattttgatctgggcagtggtttcacaaatgtattcatacgtaataattcattgagctgtgcactttattttgttagacctcaataaaaaagtt

SEQ ID NO: 30533 - DNA, 124 bp, Homo sapiens
aagtgttgggattacaggcatgagccaccatgcccagcccatattgtagtctttggaaggaagtcactctgcacagcccatatttaaggagtggagaattatgatccacctccttgagagcaga

SEQ ID NO: 30534 - DNA, 217 bp, Homo sapiens
aggagaaataaatatttgtttaaaaaaatgcctaaatacaattttgtcaagaatgcataattttttaaaattgtaggcagattaaatttaaagaaataaggccaggcctgatggctcacatttgtaatctcagcactttgggaggccgaagtgggaggactgtttgagcccaggagtttgagaccagcctgggcaacagaacaagaccctgtcttta

SEQ ID NO: 30535 - DNA, 893 bp, Homo sapiens
aattccttcagctcaaaatattcaatatgctggggtgccatattttcaagtagcatgtcctgaaccctgtgatagttataaaaaagaataaaagattgagatgtatatttcttggcagggacagtatgagcaaaaccaagagctggccatgagtgtgggacacttagggagttctttggagagcaaatagtaaattcaatggctgttgagtcagtgaggagaatggattgactcaggagcaaatggtttcactttaattggacagtctatcccacccttccaggactgtttcagtatgaaagaattttattgtcatgtgaagagtgaaaacaaactgaattttcaattaaaatggagagactatatgtcagtatttgcctgccagccagtcccctaacgaaatcactgtcaggatcgattaccagcttcagaccaaggaagagccccagacacagatgatgtttctccaggtggcacgttctaagcatgccccacatcagttctgatttgaacacataaatatcatctccctcttggctccgaaaccctccttcatcactgtgtgccaagcaaggtttgtgagcgtcatgccagtcatcttggcagctctggtgaatggtgctgaatatgaattcctacacttcagagtctctaccctttgatgtagacagcgcatgtttccaagttaatccaaggttgtgcaggagtgcagcccagaaccctaaaatggatggaaactgaaacttcagctgttatctgttgttatacaaaacatggactgctagtccaagtctttacttccatatgtggctagctgaggtgagcgacacagcagagactctctacaagaccgggtaattaaagtaaattcatttttcttttcatgaaaaaaa

SEQ ID NO: 30536 - DNA, 495 bp, Homo sapiens
acccattcactcacccccaaaactgggttcagtacaaaatcaaagtgctgggcctcgtgtttaaaaattaagaatttcaagataatgatggtacaaaccaagtgcagggcccttctgtgcaatgcaggtcacaggcccaggaaggctcattcccatgcacagaatgacacagagcagggtatttataatagctaagtcagggggttagaaggaaggtggggagggaataaggactcttctctagttaaaccgaacacaatttctgggatttactaaggtagctggtagggatgttggtaccctacagcaaagctctctgtatatgggaatttgggagacccccagtttaacagtaggcttcctgtcagcttactctaaagcaaagtctctaggcagttttatgcttcattcttaaacatgaaaaggacaataattaatcaccagatatttgacaatattctttcacatgacaagaaagagcaagctaaaaaaata

SEQ ID NO: 30537 - DNA, 853 bp, Homo sapiens
ctggatacttgctgctctactgctagactctcctcctctacaggagtcaggaatgaattcctggccattgcattaatccctttagacccaagcatgaattagctgacctgtggttatttccccttgccctggctgccaggctgctggcaaagtgaccatttgcccacttacatcctcattatgggaggtagagccctcccgatgcctgtgctgattccctccgtgtaagaaggatgcgtagttgttggtagtcccacgaggcaaatagctacactcctttgcctgggctctctggattcttgcctcttttgtttttaccctctctgtgcttatggctctacccttctccaccttccatttcgctcagtttggtttccttactctctctagaccatgtctttttcatttccatgtacttaccattagtcatgtgtgcctcttacctaaaagtgtgtccgtctttcatttccttcgtaaatttaggcaactatatgagtattcctgggttgttttggattgagtgagccttaagatatgacagctcctagcacacagtaggtactcagaaaatgttagcctctgtgctggactgatttcatattttaccccaagtggttcatgtaactagggggagttttgcttcacactattaaatccactttaaagaattagtattcatgaagcacttagaactgtgcttggcacatagtaagcactatgtgtttgtaaaataaaacttctaccttatttgactttttaaaaattgtaatttatttttatgagaataatgcagctctggttttgttacctatctcaaaaacttacttataaatgggtacagtaataatttata

SEQ ID NO: 30538 - DNA, 390 bp, Homo sapiens
caatcccagccactcaggaggctgaggcaggagaatcacttgaacccggtaggtggaggtttcagtgagccgagatcatgccactgcactacagcctgggtgacagagcgaggttccatttctaaaaaaaaaaggtcggggggaaatccaactgtaaaactgtggaccttgaagatggtaccctatattgaataactcctcaatagacaggtgtttgttaagtaaaggaatacaatgtgtgcgtcccggctttgtacagaaactagaatgttgcagcctctgtttcctgaaagacccatcaagcaaaggggcagtgtgccccatttcccagctcccatcccgattcagccctgctctgcggggagcctgccatgtgctatgttttacttc

SEQ ID NO: 30539 - DNA, 381 bp, Homo sapiens
ctgtttccggcacaggccagctgctgtgaatacagctgccttctgagtgcccgtcggggatgctgatgggctgaaacaattttattttcctgctgtcagggcaggatctgctcgtggctcccccataggcctggggagcaggaccctgcccgcccgctgtgctcccgacacctttggtcatcacgccttggctcggacgtcggtttcagatgtgcagttctggggatggggatgccggggtcggtggaggcagctcagggtggccgggccacgcgattgcagaagggacatgtatccaggctgtagtgaccttcccgtgttcttgagggactgctccccggcaagtcttcatctccagcaagactgaccagaggggccaat

SEQ ID NO: 30540 - DNA, 427 bp, Homo sapiens
cctgggggacagagtgagactctgtctcaaaaaaaaaaaaaaaaagttatatctaatgtgctcagaagttaacaatagagcaaaatttcatcaaggctgtgtgtgagggtattatctagttacagattacagaggcttggctgggcatggtgacttaacacctataatttcagcactttcggaggcccaggcaggaggatcgcttgagcccaggagttcaagaccagcctgggcatcacagcaacaccttgtctctgcaaaaaataaaaataaaaaattaactgggtgtggtggcatgcgcctgtagtctcagctactcaggaggctgaggtgggaggagtgcctgaacccgggagttcaaggcagcagtgacctatgatcgagcccctgcactccagcctgggcaaccaagcgagaccctgtctct

SEQ ID NO: 30541 - DNA, 845 bp, Homo sapiens
tcctccctccctccccatccccaatcctgattcctgtttacaaagaatgttgaaaaacaaggaattatgtataacagttcccagtttgctcaggaaattctcagattataaagagacattacaaatgaacaagtgaagagaagaaccttggtggttccaacatagtatggccattgttttatactcaaaatatagaaagacaacctcagaataagaaaacttttggaatggaataaatcaagtttatcattaaaatgcaaagaaaaaaactctccaaatgttgctgatcttctattttaaactactgttagaccggagaagcggagagcaggggaatccgccaaagagttttggatgaaaattaatcagccctgtctaccgtagtcacaccccactgcccttgagacccaatccttcggaaggagtgtccaagaggtataaagcaaaacgaaaaaacagttcgcaaattccagagttcgttttctctcattaaaaatataaatatcaggctaacacatgttgacacacaataacagggacacagaatccctcctggaagaccgacgggcccacggaccccacgggtgccacggtggtggacgaggttaagtaacttggttcagggtgtctgggcacacctctgcgtgagactctgtctctgctgctcctctcatctctacgccgattcctccccacaatcctcccttttccttgggcccccgacgcctctccgaccaacagtctccccagccccgcagcttctctctttcagacctttacttcttgatcctcactccatagtgagatgtggcctttcagcaaataaattgtgctcagggagactg

SEQ ID NO: 30542 - DNA, 164 bp, Homo sapiens
gcaagggccacaaactaccattgtcctgaagggcacatccctcagaagaaaaaagcctttcaggagaggcttgcattgtgtggacaaggcatgatattctagaccagtgctgtctaatagaattttctacaatgatggaaatgttctatacctgagctgttcaa

SEQ ID NO: 30543 - DNA, 418 bp, Homo sapiens
actatttctcatttctttggtatggctgactgattcctcataattagtttgctccttgtcaaactttctatatcccccatccttagtatgagagcagcatgctggtcctcctcctttcctattggagaaggctgcccattgactctcacatattgctgtttcttttattcatgacttgtcactcacagaccaagcagcaatgacctgtttgctttagcaaataaacaaatggagtaccagcccagcttgcctcctgaccaccctttcatgaagaacattcacatctgagcaaataatcccttaggagaaaagactacttacaaaccaaaaccaaaacaaaacatcattggccatgagatatgattctattctctttcttctgctaattctcagaaacttgggtagtcaccagtataac

SEQ ID NO: 30544 - DNA, 436 bp, Homo sapiens
tgaagaagaaaaagaagcccttttgaatgtgtcaaatttggtattctagtatgaaatcaatgaaggcttgcttaataccattccatgcaactctaatagcatttctagatgtcttgtgaagccactggagactttgaaggtgtctacttgttgccatcgtctcatttgcctgtgtttgtggtcagtgtcttggatgtaagacataccagaatacttctcagtgtggaatcatgaaaacatatagcagctcacgaatgcttctcaaatttctgagtgaaatcagtattgtcaaatagctgactattttcatgacagtgtcatacaaactcacaggaactgagtgtaaaagaagagcgttacaatgcttttccgggcatgctccatcgtctgggggacttctgactagctggattaaagaaatgcaaagtcggataga

SEQ ID NO: 30545 - DNA, 753 bp, Homo sapiens
ggaaaaagcaggaaaagaagggctcaaccgccaatgagagattcatttcagtggccactgaatgcccctcaccaactcccatacttgctggcctaggacttctcgtgtgacagtcactgagctccaggctgtgcccgacccagagaggagcaagcccagccctgccctcaagttcctccagcagctgagaggggagaggaataagcaacgcatcttcagggcacgacttgctgccagggtgggtttaacggtgttactgcagtttttcagggatatggagtgatactaatttgtattccctactccaccctacacatgtcaaatgaggccattttccccaagtcttgatagggtaggaggagtttgggctctttttctatgaaaaatcaatatctccttggagaattattaaaattataaattgaggccaggtgcggtggctcacacccacaatcccaacattttgggaggccgaggcaggaggattgcttgagccctagaatttgggaccagtcctagcaatagagtaagatgccatctctacaaaaattagctggttgtggtggcatacgtctgtagtcccagctatttgggagactgaggcaggagaattgcttgagcccaggaggtcaaggctgcagtgagccatgatcacgccactgtactccagcctggtcaacagagcgagaccttgtctcaaaaataaataaataaataaataaataaataaataaataagattataaatggaga

SEQ ID NO: 30546 - DNA, 523 bp, Homo sapiens
ttctcagtgtaacaaatgtttattcctatgtaattaagggcgtatttcctgtacagaatattcatattacctaattgaaaattatatgatacaaaaatataatactatttttagccaggcatggtggctcatacctgtaatcccaacattttgagaggccacgtttgggagaatcatttgagtccaggagttgaccagcctgggcaacatagtgaggaccttgtccttattaaataaataaataaataaataggttgggcactgtggctcatatctgtcatcccagcattttgggggttgccaatgcagggaggattgcttgagcccaggagtttgagaccagcctgggcagaatagcaagactccatctctacaaataataaaatattaaccaggtgtggtggtgtgcacctggggtcccagccacctgggaggctaaggtgggaggtttgctcgaggctgcagtgaactgtgaatgcaccactgcattccagcctaggccacagaacaggaccttgtctat

SEQ ID NO: 30547 - DNA, 995 bp, Homo sapiens
cacatacttttaaaccgccagatctcacaggaactcattatcacaaggacagcaccaagtcatgagggatctgccctcatgagccaaatacttccctccacgccacacctccaacattgggatcacatttcaacatgagatttggaggggacaaatatccaaaacatatcaataaatattgcattgaatctgtagatcactatgagtagtattgacacatttactatattaactattccaatccatgaacatggaatgtgttttcatttatttatttatatcgtctataatttctttcagcaatgtttgtagattttagtttataggtctttccctttcatggttaattcctacatattttattctttttgatgctagtataaatagaattgttttttaaatttccttttcaattggttcattttcagtgtatagaaatgaaacttatttttgcatgttttatatcctgcatctttgctaaattcatttattagtttttacagagtttttaaaatgtggaatctctaggggtttctatattaagatcatgttctctgcaaacagataattttacttcatcctttccaatttcagtgccttttctttttttttcttgcctaattgctctggctagaacttctgttagtgttgaatggaaatggtgaaagcaggcatgtcttgttcctgatcttagaagaaaggcttttagtctgtaatcattaaatatgatgttaattatgtttttttaatatattgcctttattatgttgaggtagtttccattcctagtttgttgattgttcttattgtaaaagagtgttgaattttttgtcagattctttttctgcagcaaatgagatgatcatgtggtttctgtcctttattcttttaatgtggtgtattacaatgatccatttttatatgttgaatcatgcttgtattccaggaataaatacaactttgtcatagtgcataatcctttaatatgctgctga

SEQ ID NO: 30548 - DNA, 386 bp, Homo sapiens
gctctgatcctaaccaatcttagtgtatgggatatttataaattcaaagaatcttttttttattcttctctcacattacaattcaaaaatgagagatggggctgggtgctgtgactcacgcctataatcccagcactttgggaggctgaggcaggtggatcacaaggtcaggagttcaagaccagcctggccaatatggtaaaaccctggctctactaaaaatacaaaaatcagccaggtatggtggcacgcacctgtagtcccagctacttgggaggctgaggcagaagaattgcttgaacccaggaggtggaggttacagtgagccaagattgtgccactgcactccagcctgggcaacagagcaagactgtctgaaaaaaaaa

SEQ ID NO: 30549 - DNA, 440 bp, Homo sapiens
gctccagaattcaggtccacagggtaggttggatggggatggcgctaagtaagggtttgtgtggctgctgtttcccttttgttggtaaggacttaaattaagcatcactgtgacctgcaggctgactatgacatgaatccctcccggtggatggtgttgccagagtcctgatggtcttggatgagcagtttgcccagggaagagcagggaggtaactgtgactgcagttcacatcttggtgatattttccaacctgtcatcacaaggaagcctatggggcctttccctctcctccttgaaaagctctgcagtttactcccttcagcatgtggcatcttcagtgggatgggcaaggccaccaacctgcaaacatgcatagagggacccatcttcagatgcctctctgggcacagcagggttgctcttatcaaacagaatga

SEQ ID NO: 30550 - DNA, 543 bp, Homo sapiens
aatgagtagaggatgaaagggttattctatatgggatggtcaaggaaggcctctcctgtgaggtgacattggaatgacatcttactggtaaaacagtcagatatgaaacagggaagagtgttgcaggcagaggagtaattgcagaaggtcttggactgttttagcatgctccagggtgggaggaggtcatccaggagggtgtgggtgggaagaagtagttggaaaggaggtcagagggcctggcgtcaactcttccagggctctcagatttcatcctgggtgaaaaaggaagccgtatgtttgtgtatatattgcatgtattcacacacagaagaaacactgaagtgtatacaacagaattttgaaagttgttgttgaagctaggtaaccgtggaagagagtatagataactgtttctcctttcttttctccaccttccaccacattagcagtaacctattctgaatgtgagattataattcctatgtatctcttaatagttttactgtgtttatatttatcattaaaacaatatgcaatatt

SEQ ID NO: 30551 - DNA, 536 bp, Homo sapiens
gattctggctttttgcagccctagcacaatgcctgtccccaagtaagtgctcccagagtgtttgttgacctaaactgttgaaccaaatagtgacaaagaggatggattttaactgagcattagaatgcaccacagaaactcatggattctttgtatttttggtggttaggcccattctaaaggaatgctacaagtaaacaactatagtaagctagtattgacttccttgggcatttcatattgcttgcaataaggtggacagcaaggtagggtagagaattggcggagtaacttcagcatatatacatgtgaaagaagttgagtggcacttcagctgctcctcaccactcttaaaggttttccatgaaatggaggggagaaggaaacttcacttcctgttagtgaaattccatagcaatataagacacgcaagagcaacatagtagtacaaaagtccctacatctcattgattatctttaagtgtttggatttgaagtaagaatatgtgttcttctaccctctgcagaaaaaaaaa

SEQ ID NO: 30552 - DNA, 343 bp, Homo sapiens
taatccatgttctacttcattttccatttgtctgatattgcttttgaaactcattttaccaggccaggcgtggtggctcatgcctataatcccaacactttgggaggccgaggcaggtggatcacctgaggtcaagaccagcctggccaatatggtgaaatcccacctctactaaaaatacaaaaattagccagatgtggtggtgcatgcctataatcccaggtactcaggaggctgaggcaggggaatcacttgaacccaggaggcggaggtcacactgagccgagatcgcgccattgcactccagcctgggcgacacagtgagactccatctcaaaaaaaa

SEQ ID NO: 30553 - DNA, 392 bp, Homo sapiens
  misc_feature (322)..(322): n is a, c, g, or t
  misc_feature (327)..(327): n is a, c, g, or t
  misc_feature (336)..(336): n is a, c, g, or t
  misc_feature (349)..(349): n is a, c, g, or t
  misc_feature (365)..(365): n is a, c, g, or t
  misc_feature (381)..(381): n is a, c, g, or t
gtgtgattatgcatatttgcatctgaattaattttgacttataataataattaaaactttaagatttgtttttggtattattcaagtatgaaccattcactgaagacttattctaaagccagctctatcccaagttaaataacttgataagtataatattttcagtttataggccattgtttaaaattgtgtatataacttcatatgcttatgaagtaaattagaagcattttacatacatttgtttccaattctttttcaccaagtatcttatccccagcccccccatcttcccccacccccagcccttggccacagaccngcagngaacttttngcgtactcttttnaggcctcacctgttangttagtttcctctttntccagtacctt

SEQ ID NO: 30554 - DNA, 402 bp, Homo sapiens
tttttttttttttttttttttttgagacagagtcttactctgtcgctaggctagagtgcaatggcatgatctccctgctcagtgcaactcccaggttcaagcgattctcctgcctcagcctcccaagtagctgggatcacaggcacgtgccaccacacccagctaatttttgtgtttttagtagagacagggttgtaccatgttggtcaggatggtctcgatctcctgacctcgtgatccgcccaccttggcctcccaaagtgctgggatttctggtgtgagccactgcacctggctgcaaaacttactcctaaactaagaatgcttttgtttttaagatattgggacatcagggcatttcctgggtctattaagtcctgagtctgttggagaaacattatt

SEQ ID NO: 30555 - DNA, 527 bp, Homo sapiens
cacgtcccctcccggtctcatctgccgcttgctcaccttggctgtccatgcacccgtagctgtgaccatgggcggtggcgccagctcggacttcaccccgttggagcgggcaggatgtcacactgagctaatgtgagattgttcatgaagctacagatcttagtgctacttgggcttctcacagcacagaggaggattctgaagtgagagataaattggcttcatgtatgagcaagggggaaagtgttttattttactaggaagattttactgaaagaccaatcccgaaacggcccttgcttcggccacagctgctgggatgtcctcgggcctcccctgtttgtctgcatgtcttcttgttgccatcggggcagtggggtccccggaaacagtccaaggccctggggtgggggatttaaattttttggcttccctcagacctcagaccgtgtgggtttttttttctttctttctttcctgttcatgggcatttgattaaaagtttgtgtttaaagaaaaaaaaaaca

SEQ ID NO: 30556 - DNA, 726 bp, Homo sapiens
attattttgctcagaggtttgtggactttgcatactgattctttcctgtttccaagtacatttgcttttaggctatttttattcactttaaaggaattttaataactttctgttgacagcatggacagctggtcttgagaattaaagaaaattcacttgctgactgaggaaggaagtgacatcaatgagcttctaaagtcagcccagcgggggaaattggctggtgagagagtagcctttcattgcactgtatttatcgagcgatgccttgagatgcaaattgctgtatcaatcaaacctgtggtgcctacctccaaccaacccagtgcaaactgaaggaacaatgccctgaaacactgagaataaaaaggatgaggggtgcaggagcccagaggctaagtgaattacggagctcagaatgctctctcaccaagcctatacttcattctctgtcaaacctcagtttctttgtctagaaaatgagttttatggaaactgttggttgaagtcagtctgtttctttgacagatggctaagaggaccaggtactaatatagatagtgtagacatgctatctcagtacgtttgtcccaaagagagctatcaattgctttttatcccctactgagagctatttagaaataggaatttttagctgtcatacttagctactaccttgatcctttgttttaaaaccctgtattcattgtttataactacactgca

SEQ ID NO: 30557 - DNA, 672 bp, Homo sapiens
attattttgctcagaggtttgtggactttgcatactgattctttcctgtttccaagtacatttgcttttaggctatttttattcactttaaaggaattttaataactttctgttgacagcatggacagctggtcttgagaattaaagaaaattcacttgctgactgaggaaggaagtgacatcaatgagcttctaaagtcagcccagcgggggaaattggctggtgagagagtagcctttcattgcactgtatttatcgagcgatgccttgagatgcaaattgctgtatcaatcaaacctgtggtgcctacctccaaccaacccagtgcaaactgaaggaacaatgccctgaaacactgagaataaaaaggatgaggggtgcaggagcccagaggctaagtgaattacggagctcagaatgctctctcaccaagcctatacttcattctctgtcaaacctcagtttctttgtctagaaaatgaaggaccaggtactaatatagatagtgtagacatgctatctcagtacgtttgtcccaaagagagctatcaattgctttttatcccctactgagagctatttagaaataggaatttttagctgtcatacttagctactaccttgatcctttgttttaaaaccctgtattcattgtttataactacactgca

SEQ ID NO: 30558 - DNA, 672 bp, Homo sapiens
attattttgctcagaggtttgtggactttgcatactgattctttcctgtttccaagtacatttgcttttaggctatttttattcactttaaaggaattttaataactttctgttgacagcatggacagctggtcttgagaattaaagaaaattcacttgctgactgaggaaggaagtgacatcaatgagcttctaaagtcagcccagcgggggaaattggctggtgagagagtagcctttcattgcactgtatttatcgagcgatgccttgagatgcaaattgctgtatcaatcaaacctgtggtgcctacctccaaccaacccagtgcaaactgaaggaacaatgccctgaaacactgagaatatgctctctcaccaagcctatacttcattctctgtcaaacctcagtttctttgtctagaaaatgagttttatggaaactgttggttgaagtcagtctgtttctttgacagatggctaagaggaccaggtactaatatagatagtgtagacatgctatctcagtacgtttgtcccaaagagagctatcaattgctttttatcccctactgagagctatttagaaataggaatttttagctgtcatacttagctactaccttgatcctttgttttaaaaccctgtattcattgtttataactacactgca

SEQ ID NO: 30559 - DNA, 396 bp, Homo sapiens
  misc_feature (112)..(112): n is a, c, g, or t
  misc_feature (163)..(163): n is a, c, g, or t
atggagatgggcaaatggattcatttagagctgcggaacaggacgccctccgatgtgaaagaacttttcctggacaacagtcagtcaaatgaaggcaaattggaaggcctcncagatgaatttgaagaactggaattattaaatacaatcaacataggcctcncctcaattgcaaacttgccaaagttaaacaaacttaagaagcttgaactaagcagtaacagagcctcagtgggcctagaagtattggcagaaaagtgtccaaacctcatacatctaaatttaagtggcaacaaaattaaagacctcagcacaatagagcccctgaaaaagttagaaaacctcgagagcttagaccttttcacttgcgaggtaaccaacctgaacaactactga

SEQ ID NO: 30560 - DNA, 326 bp, Homo sapiens
gcctggattttccaccactgcccaaagaaaatgaggcttgcctcatagtgtgtgaagccacatgtcaagtactaatgagacaccccttctctctctgatctagagtatgttagcacaggcttagtgggagcctaaactcctacctcctccaagtagtaactgaccctcctaccctgtgtcaccggagactgagtagggaaacctgggacttttaggccccatcttgacatcaatgaagtgactaccccatactcttcacccactggtagatagtcaggaggaggcctgctaaaaatgctagatttaaatatgatccagaatataat

SEQ ID NO: 30561 - DNA, 1024 bp, Homo sapiens
aaataaccgcaggatgggctcagggacctgctaggcccactgagacagacctgagctaaaactccattgatcacttgacttcataagcccctactctgactgctggaccacagcgaagtttgggtcccctagaattagtgttagttcagaagccagtgtctagtaatccccaaaaaatcattgtttccccttctgcaaggcaaatagccataggtcctttggggaagggtaggagaaagataaacaggaaagtctcctcaagaggacacagcttccctttcattaaggagattctgggtctgtaaactagctcatttctgggaattgcttaaggggccatgactctcttcaggtgattcaagttatacttctgtttaccagacctagaattcttctgcttatacagatcaagtaagagttagtagactgcccatctatttcttttttagggacaccatgatcaaccacccaatgctataggtctcagcaagtcagactattctgattactgctttggctccactatttattatggtaactatgcccaccttggatttggcatggtgctgctacttggggccctgccaaccccgggattcctttatccccattgcatttagggatcccagttgatggtagcagttcccactgtaatttctgacctacaaagagaagcaaccacagagcaaagatgctgggcctcacctcacaaattgatttctcacagtggtggtgaagggtgcgtcctcctaacccttcccagggtgacctgtcagttctttgctccttttttcttcttcctgctttcttttggattaataattttttattggccgagccaccgcacctggccggttttcaattgataatattttcctgtggtgtcagaaccttaaaagagtatgcatttattttgtatactccccatttttgctattgttgttatacattttactgctacatacattataaattcttgtatatattggtatatttgttttagataattatctcttaaggagaa

SEQ ID NO: 30562 - DNA, 1075 bp, Homo sapiens
aaataaccgcaggatgggctcagggacctgctaggcccactgagacagacctgagctaaaactccattgatcacttgacttcataagcccctactctgactgctggaccacagcgaagtttgggtcccctagaattagtgttagttcagaagccagtgtctagtaatccccaaaaaatcattgtttccccttctgcaaggcaaatagccataggtcctttggggaagggtaggagaaagataaacaggaaagtctcctcaagaggacacagcttccctttcattaaggagattctgggtctgtaaactagctcatttctgggaattgcttaaggggccatgactctcttcaggtgattcaagttatacttctgtttaccagacctagaattcttctgcttatacagatcaagtaagagttagtagactgcccatctatttcttttttagggacaccatgatcaaccacccaatgctataggtctcagcaagtcagactattctgattactgctttggctccactatttattatggtaactatgcccaccttggatttggcatggtgctgctacttggggccctgccaaccccgggattcctttatccccattgcatttagggatcccagttgatggtagcagttcccactgtaatttctgacctacaaagagaagcaaccacagagcaaagatgctgggcctcacctcacaaattgatttctcacagtggtggtgaagggtgcgtcctcctaacccttcccagggtgacctgtcagttctttgctccttttttcttcttcctgctttcttttggattaataattttttattggccgaggcacagtggctcacgcctgtaatccccaaagtgctggattacaggtgtgagccaccgcacctggccggttttcaattgataatattttcctgtggtgtcagaaccttaaaagagtatgcatttattttgtatactccccatttttgctattgttgttatacattttactgctacatacattataaattcttgtatatattggtatatttgttttagataattatctcttaaggagaa

SEQ ID NO: 30563 - DNA, 313 bp, Homo sapiens
gacttacagcactttggtctacagtgtcttcagggtcacttgggtgaaagaggcattatgggtccagaggtgtttggctcttcttttctggaggctactgctagagttgtgggtgtcctatagtcattgattgctaagagtgtatcacttaaatgaatgtgcagtcagcaagacctgaggagtttactgcatgaggaagccaattgaatggccttttcccaagtcatgttttgtgagctgtaaatctagagcagtgaggagggggcttgaacccaggaggttgcagtgaggccagatcacgccattgcactca

SEQ ID NO: 30564 - DNA, 640 bp, Homo sapiens
aaccacatcagcttagaatttagagtcctatttaagcaaagagtttagaataactccctcaattcttgattaaatctatattgatcataactaagttaataataagtaacagtttctttgtgtggtggtgagaagatgcatctgtgatgctgaatttggaatatcatgggatatgtagctaacactgtctaataggcaattggttatatatctcatgctcagcagagaggtctggcctggagtagagctctggtgtcatcagtagagagactgatatatagcagcagaggagtctgtctaaagaaggtgtgttgggggccttgtccattctttcccacttaaaagtgcagtttttcggatgtggtggctcatgtctataattctaccactttgggaggccgaagtgggaggattgcttgagactgggagttcaagaccagcatgagcaacatagggagaccctgtctctacaaaaaattaaaaaattagctaggtgtcatggtatgtgcctgtagtcccagcttcttgggaggctgagctgggaggattgcttgagcaaaggagtttgaggttatagtgagctatgattgtgccactatactctggcctgggagtcaaagtgagactctgtcttttaaaa

SEQ ID NO: 30565 - DNA, 587 bp, Homo sapiens
aaccacatcagcttagaatttagagtcctatttaagcaaagagtttagaataactccctcaattcttgattaaatctatattgatcataactaagttaataataagtaacagtttctttgtgtggtggtgagaagatgcatctgtgatgctgaatttggaatatcatgggatatgtagctaacactgtctaataggcaattggttatatatctcatgctcagcagagaggtctggcctggagtagagctctggtgtcatcagtagagagactgatatatagcagcagaggagtctgtctaaagaaggtgtgttgggggccttgtccattctttcccacttaaaagccgaagtgggaggattgcttgagactgggagttcaagaccagcatgagcaacatagggagaccctgtctctacaaaaaattaaaaaattagctaggtgtcatggtatgtgcctgtagtcccagcttcttgggaggctgagctgggaggattgcttgagcaaaggagtttgaggttatagtgagctatgattgtgccactatactctggcctgggagtcaaagtgagactctgtcttttaaaa

SEQ ID NO: 30566 - DNA, 1219 bp, Homo sapiens
atcacactgagagatttttaacatatcagtggggaaatggggttcttgaacctctggaaaacttgaagctgagattgttcaggggtccatgagtctgatgttggtaaacattcctcatgtacaagccaaagattatttgtataaattttggaatggtgatgtgaaccttaggtatgaaaaggcagtaacatataacaagaaaataattttctagatctggggcaacagtgtgcaaataatgtccccagtagagaagcaaatccttttcatggactctagggcttgctactctgagatacaatgcctctaatttcatgctatgtggctgctttgtctttgatcagatttagtgtcttaggtaattaaatcagaaagtctatttagctattctagaagtgtatgtgtaggtattgggtgggtggggttctttgagcgaacttgtcagaaactccattcttaacatcagaatcagggcaggattgaaaacattgtggctggatcttgaaattgctataacatctattgcagaaaatgataggtcagatggatagcaataataattatatatcagatcttagtaacaaaattaccaagctttatctagtggatatatgtaaaagaatatttttaaatgtccagcattgatgtattttctttaagaattattacagtatataagcattctttgggaatacagtataaaaacataaattttttcttatttttaattttttttatttttttgttcaaggatgaatcttccctttaaatattaattttctcttaatttcgtgtttccttgcacataatagcactgcccctaacttcagagatgctgattgcagttaaaaaatcaaaaagaaatgatgtgaatcagaaaataccatgttgtattgaaagcaaatcaaatagtgtaaacaccatcaccagaactctgtgcgaacaagctcccaagaggagggcagcttgtaacttacaaaggctgttagagaactcagagcatcagagcataaagcatgtgggatccaaagagacacatttggaattccagtttggggatggtagttgcaagcacctaaacagtttgccaaggaatgtttctcctgagtttgttccttgtgaaggtgaaggaggctttggtttgcacaagaagaaagacctactcagtgataatggttctgaatcacttccgcattcagctgcatacccctttcttgga

SEQ ID NO: 30567 - DNA, 330 bp, Homo sapiens
aggtggaggaaaagggcaggactcagttatgcgactgaagtctaatggaccattatataacatagttttgagcaagagtgacatgtcacactaactgaggttcaagggagctactctgggagacacaagtggacagaaggttagttaggagactatgtcaatacatagagcttaacctgatatcctcaaaatgctttcaccctttaggttttacagggagggtggaaggtaggaaactactttttaaatttcattatatctaaacaaatacacgtaaagtcatgtatacacgctgtaacacacattcctctcagtgactttgttagtcag

SEQ ID NO: 30568 - DNA, 330 bp, Homo sapiens
tgtgcttcctggaaagttgacatggggatagggagctttcctggaagttggggctaagtatgggagtagggtgcaggctcaaggataacattttttgggtgtttggggtaaagataggatagttgtgagccaagcagagaggaggcagagctgggggcaggggtgggcccaagagggtgcccgggaagtggagtttagagaagctgcctgtgtgcagggagggggctgttgaggatgccccaccacttccaatgtcatctcataatgtgattggcaaacgtgaggttacatttcacaatgtgtttctttaatgatctataagccagttat

SEQ ID NO: 30569 - DNA, 644 bp, Homo sapiens
cttactttcaggcaagcaggggtgtttttctatgatgtgtctttctcttaaaagcacctctgattaagtttagcacagtcaggacaatctccattttgataaacacaaagtcaacacatgagtaacctaatttcttgagtgattttcccaccagttgcacatttttttacactcaaggaaaaagtattacacagcaggtgtgcaacagactgggaatccagcgtattatcttagaatgttacctacccacttgaataaaattttaaaatagtctttctgctgttttgttatctacgtaaacaaagacattatgtgcaaataataattaactactttccagttttattcattacaaatattagctaacatctttttttctggcttaaattattttgtccttatgtaccaatttatacattcgcacacacatagaacaacaaaaatatacccaattatatacttttggttacattttcattaaaataagtgttataaataatttgtttgtttgaagagggcttttattgttgtactcaagagtgttatttatggagacaaaattgcctgtgcttcaataggcagattctggaaagaatttgaaacataagctataaaattttacattaataaattcaatacaaagc

SEQ ID NO: 30570 - DNA, 409 bp, Homo sapiens
aaaaccacacactaatatccctcataaatatagatgcaaaaatccaaatagaatgcaacattgtatgaaaataattggatgctgtgaccactcaaggctggtcagagtttggaaatcaattaatgtggccgggtacgttggcttatgcttgtaatcctagcactttgggatgctgacgcagatggattacctgatgtcaggagtttgagaccagcctggccaacgtggtaaaaccctgtctactaaaaatactaaataagctgggcgtggtggaatgcgcctgtaatcccagctcctctgaaggctgaggcaggagaatcgcttagaacctggaacgcagaggttgcagtgagctgagattgcaccattgcacttcagcctgggtgatagagcaagattctgtctcaaa

SEQ ID NO: 30571 - DNA, 473 bp, Homo sapiens
tgaagacacttgctctcttatctcctagcctgagtgctccctcctctgtgacaatctgtctcttccttgagggctgcatggaacagggatgttaataaagagaagaatgggtgtgtagtaagtttcctacaatgaaaccctctggttttacatgctccagtgacttcctgctgatcataaggtaaagttcagaactcttaatttggcttgactccttgccctgtgctccgctgtctatgccttggtcctgctggccttcctgtttgcccctgagttacactcacatccactcctgagcctcaagcctgtgattctctctgcactgacacttgctctcccccatcccaccctgtaccaggtttgcttttatttctccatctgcatcagctaaaagtcacttcctcagggagtcctccctgaccatcctggctctcaggccttggaatgagccccacagcttcctttcctcatgg

SEQ ID NO: 30572 - DNA, 442 bp, Homo sapiens
gtgagccaccgggcccagcctgctttatatctttgatatgatttttctgtgtgtaaataaatgtatacagttttacaaatatggggccgtttactatatgtagttatgatgctttttttttttttttgagacagaggagtctctctctgttgcccaggctggagtgcagtggcgtgatctcggctcaccgcaacctctacctcacgggttcaagtgattctcctgcctcagtctcccaagtagctgggactacaggcgcatgccacaattgtctagctaatttttttgtatttttagtagagatggggtttcactatgttggccaggctggactcgaactcctgaccgcgtgatctgcccgccttggcctcccaaagtgctgggattacaggcgtgagcctccgtgtccagactatgatgcatttttaataatacaaatata

SEQ ID NO: 30573 - DNA, 1098 bp, Homo sapiens
atggccagtacagagtcctccctgttgagatccctaggcctcagcccaggtcctggcagcagtgaggtggagctggactgttggtttgatgaggatttcaagttcatcctgctgcctgtgagctatgcagttgtctttgtgctgggcttgggccttaacgccccaaccctatggctcttcatcttccgcctccgaccctgggatgcaacggccacctacatgttccacctggcattgtcagacaccttgtatgtgctgtcgctgcccaccctcatctactattatgcagcccacaaccactggccctttggcactgagatctgcaagttcgtccgctttcttttctattggaacctctactgcagtgtccttttcctcacctgcatcagcgtgcaccgctacctgggcatctgccacccacttcgggcactacgctggggccgccctcgcctcgcaggccttctctgcctggcagtttggttggtcgtagccggctgcctcgtgcccaacctgttctttgtcacaaccagcaacaaagggaccaccgtcctgtgccatgacaccactcggcctgaagagtttgaccactatgtgcacttcagctcggcggtcatggggctgctctttggcgtgccctgcctggtcactcttgtttgctatggactcatggctcgtcgcctgtatcagcccttgccaggctctgcacagtcgtcttctcgcctccgctctctccgcaccatagctgtggtgctgactgtctttgctgtctgcttcgtgcctttccacatcacccgcaccatttactacctggccaggctgttggaagctgactgccgagtactgaacattgtcaacgtggtctataaagtgactcggcccctggccagtgccaacagctgcctggatcctgtgctctacttgctcactggggacaaatatcgacgtcagctccgtcagctctgtggtggtggcaagccccagccccgcacggctgcctcttccctggcactagtgtccctgcctgaggatagcagctgcaggtgggcggccaccccccaggacagtagctgctctactcctagggcagatagattgtaa

SEQ ID NO: 30574 - DNA, 266 bp, Homo sapiens
aaagtttttgtttctgaaattgctctaaaaatgtagcttttgactttttttgaggtgaaattcacataacataaaattaactattttaaagtgaacaattcagtggcacttagtgtcttcacagtgatgcgtaaccgccacctctatctagttccaaacattttcactactccaaaagaaaatcctgtacccattaggcagctgcttcctatttctccctctccccagccctgtactttgattttattttgagatggagtatcact

SEQ ID NO: 30575 - DNA, 334 bp, Homo sapiens
tggctgctctggtttcagaatccagaggatcagtcacaggcctaagcgcctgtccctggtccctccacggtctctcctgctggggacacgacgggctgtgaagagggtaaaaataatacacgcactgtactttaggcactaactgtcagcatgtggtataaagttagacgttaagagaaattcctgtgctcctagctgcttcatcatacagtgatgaaagcagaaagcacaaacacagggtcaaagtggagaccggaatcacaggtgtgcatcccaacccaccatgactggcaaaccagcagtgggttcaagggcactgctggcctcttcctct

SEQ ID NO: 30576 - DNA, 222 bp, Homo sapiens
atatcttttggccatttgtgtgtcttctttggagagatgtctattcatgccctttgaccacttttttaatagaattactttgttgttgtttttgtcattgtttttactatggtgttgagttccttatatattttgaatattaaacccttatcagatacctagtttgcaaatgtttttctcattccgtaggttgcctttttattttgtgtttcctttgctatg

SEQ ID NO: 30577 - DNA, 212 bp, Homo sapiens
agagccgcggcaggagaggtagaggtacaatctcccgggccccgtctggcgtctgcttcaagtgaggcaactcaggacactgggccagccggtgccctagccaacagcaaccgtcctgcccgccttgcaactgtttcaagtgtggcaatccaggtcattgggcaaaacagtgcccaaaccccaagccgccaacacacccgtgccctaactgc

SEQ ID NO: 30578 - DNA, 873 bp, Homo sapiens
ctttctagggaactctgttaggtgtttagagagatactaaaaataatagtaattagcaaaaagggtgcttactgtatgctaggcactatgtactttacacgtattaattcttttaatattcataacaaccttaagaagtggttattgttattccaagatgaggaaatagaaacaaaggttcaataacttgcctaaagtcaaataggtagtaactggggaaactggaattccaaccgaggcagtctggctccatatccaacctcttaaaacacttcactttgctgctctaatttctgcctatccaggaacttaatctagttgctaaaaacaaatgttgttagctatctcttacattaggcactaagctccactgggcattggccctgcttgtctcctttgccaccataggggtttttttgttttgttttgtttgagacagagttttcctcttattgctcaggctggagtgcaatggcgcaatcttggctcactgcaacctctgcactcccaggttcaagtgattctcctgccttggccccccaaatagcttggattacaggcatgagccactatgacccggctaattttgtatttttagtagagtagtttctacatgttggtcaggccggtctcgaactcccgacctcaggtgatttcgcccacctcagcctcccaaaatggtgggattacaagtgtgagcctccgcgccccagccaggggtttttaattctactaaccagatatctattagtgcccagcatggttgtctggcatacactatgaagaaagaaaccaaaggaatgcaaggaggtaggaaggataaggaagaagaaagaaggaaggatttccacatataagacagtatatagttag

SEQ ID NO: 30579 - DNA, 286 bp, Homo sapiens
cccaggcatcaggactcagagtgaacccgaacaagaaagcaaagggcccaaagggccgcctgcctcccggtggctctccccagtggggacaggtgtcaccatgatttgcaagtgacacagcccagctcaagctcacagcccaaactcttggtggaaggaagtaaggtggagcagagagaaaatgacgatcacaacaataaccagccctcccaattatcattattatttttttgagacagagtctcactctgttgcccaggctggagtgcagtggcgcaatctcagc

SEQ ID NO: 30580 - DNA, 317 bp, Homo sapiens
tgtgccacacacatcacatgcatccaagtagacggaagccaagggactgctttcctcctctgtggcttagtgcactttcagaaaggtgctagcaaacaggcatgatatcacaatagttacatctactttctaatggcaaaaatgaagtagtgatttactagatcctgtattgagaacatctgtgtcttagatgaatagttgtcttacgactcttttcttcatcctataaaatacttctaggctgggcatagtggcttatgcctgtaatcccaacactttgggaggctgaggtgggaggatcacttgatgccaggagt

SEQ ID NO: 30581 - DNA, 301 bp, Homo sapiens
taccactagagtttgtgttataattattttaagagtgttaaatgcttttggaatttcaagattttgcaattgtagtttaagagatccctgggatataagtgctattatgctgaagcatgaatgtgcatcacagctgctttgaaatcaggttatcttcatcagtatttagcttgtgagtgaacttgggtgcctattcatcatcaaaacacttcagtttggttttgtcttcccatatgctcatgaaatttgggaaggattactaaaagttcttagttagaatttacttcatttaaaattttat

SEQ ID NO: 30582 - DNA, 619 bp, Homo sapiens
acagacagaaaaagaagaagcagatatgcgattaaaaatgaaaataacataacaacacggattattgtgatagatcctgtacctttttaaagactctgacattccacttaggagtaagatggaaaagtcccttgttctaaaatttgaaaatgataaaaataagtcatattaatggaaattaaagaaagaatatgtccattgttaggttatgtaaagggtacacatctcacttctttcacatcgttttttgatttaaattaatgtaactaaattttaaaatgacggatttaatattcatgctagcagtttatttttaatgtgaataaaattaacagtaaaactatcataaaagatagatggggccgggcacggtggctcacacctgtaatacccagcactttgggaggccacagcaggcgaatcacctgaggtcaggagttcgagaccagcctgggcaacagggtgaaaccccatctctactaaaaatacaaaaataagctggacatggtcgtgggcacctgtaaacccagctactcaggaggctgagacaggagaatcacttgaacttgggaggtggaggttgcagcgagccaagatcacgccattgcaccccagcctg

SEQ ID NO: 30583 - DNA, 328 bp, Homo sapiens
tcaccagagaaacgtaaataaaaataatatactggccagacacagtggctcacaccccaaacactttgggaggctgaggctcatggatcacttgaggccaggagttcaagaccagcccggacaacatggcaaaaccccactcctactaaaaatacaaaagttagcttggcatggtggcaggcggctgtagtcctagctactcaggaggctgaggtgagaggatcacttgagtccgggaggtggaggttgcagtgagctgagattgtaccactgcaacactctgggcaacagagcaacactccatctcaaaaacaaatataaaataaaa

SEQ ID NO: 30584 - DNA, 397 bp, Homo sapiens
atgcacactgtgacttcacattttctcttggagatgagtgtactaaattaaacttctaaggaggtgatagtcaaggagctcagagccccctcttctgttatagagccttctctcacacctgcttgttaattcttattgtgtccttttctcagaagtctgtacttgaattttaagaaactggacttctctactagatctcaggccagacgagttgtgcttggctagttctggtggtgttaagaactaatggaggcattgtttttcactctgaaagtgatctgaactagagattccaattaaaaattcttctagaaacatggtagtatagtaaaataaatgcaaagacccagatctagatgaagatggtaaagtagcaaaatgaaatttaaaaaaagaa

SEQ ID NO: 30585 - DNA, 402 bp, Homo sapiens
tcaaaaaaaaaaaaaaaggtatatccctgccccataaaatgcatacaacaaatgctcactacacagctttatggattaagagtcaggaagtcttttctttttactgaaattaacttttaaaagtgtcaataggccgggtgaggtggctcactcctgtaagcccagcactttgggaggccaaggcgggcggatcacaaggtcaggagtttgagaccagcctgtccaatatgttgaaaccccgtctctactaaaaatacaaaaattagccgggcatggtggcaggcacctgtagtcccagctagaagcaggagaattgcttgaacccgtgaggcagaggttgcagtgagccaagattgtgccactgcactccagcctgggagacaaagcaagactccatctcaa

SEQ ID NO: 30586 - DNA, 289 bp, Homo sapiens
gtcacagctggcttggctctgagcccgctcgactccaccccctgcactgaagcctcttctgggcatgcagggacacccccaaatttgcctgcagggcatgcgctctgggcaggtctctggcccacagcagtagcctctgattccttccttccttctttccctccctccctccctccctccctccttccctcccttccttccttcccttcttccttctttgcttccttccttccttctttccttccttccttccttttttttcttttctttcttttgctttcttttttgg

SEQ ID NO: 30587 - DNA, 618 bp, Homo sapiens
aagattctctctttttttttttaagattatataagcatttcagtatctatttaactccttacatgattagtttggttcttgccagtcttggattttagtttaggttagatcattctaggtttttgaaaagaccactaaatttgcaggttctgtggtagctggggtcactatttagagtaggccactgcatagaagattcaaagattcatctatattcccaaaaagtcttagaataaggatgacacagctagttagacttcctggggaatatttttgatcacaatagattggtctgaagttcaggtgttcgttaagaaccatactagcctcaagaatatagtgaatagggccggacatggtggttcgcacctgtaatcccagcactttgggaggccgaggcgggtggatcacctgaggtcaggagttcgagaccagcttggccaacatagtgaaaccccgtctctatttaaaatacaaaaattagctgggtgtggtaatgggtgtctataatcctagctactcaggaggctgaggcaggagaatcgcttgaacccagcaggtggaggttgcagtgagccgagatcgcgccactgcactttgactgggtgacacagagaa

SEQ ID NO: 30588 - DNA, 407 bp, Homo sapiens
aggctctaatcaactaagcagctaataaactcctgcctcatttcatccagccagagccctgatctcaggggatgatagtgaggaaacgatcctttcacatgcctggctcctgcaaaattgtgctaagaggattttcctcaaacattttagcacaaagcgagttttcctaatccagttagcaaatattcttctatttgaactcattgaccctccttcttctgaagatgtattttaaattggatttgcttcactgacacaaatggaaaacttgataagaaaatcggtggggttttgctgcacccactgctgatatcaaaagactcaactctgtattacagcaatgaaagctctgttctgtagctacaggatacaagctgagctcccagccaccagccctgccaatgtgc

SEQ ID NO: 30589 - DNA, 512 bp, Homo sapiens
atattatatttgcataggaatatccatattacacattatattgcagagttttacagtttaaaaagtgctttaaaatgtccctcctttaattctcacaaccccaggggttacgtatcaccttcatcttacagagaggaaacctttgtttccaaggagttgagcggcatgtgtaaaattgcagggccagtgaaggagctcagcctgaacttgggcccagggagcagtcaggacttggagaaggttctctctctcaccctgcaacccaaacaacgagcaggggggaggcatcacataggggaggagatgcaggaagaaaaggaaagctcaggccacgaggacacaacttcctcaaaacccagccctaaagccggacggggtactcacgcctgtaatcccagcactctggaaggcagaggtggagagatggcttgagcccaggagttcaaggctgtagcgggctatgattgcaccactgcactccagcctgggtgacagaatgagaccctcttaaa

SEQ ID NO: 30590 - DNA, 91 bp, Homo sapiens
cactggtccatatatctgtccgtatgtattttggttattgtagctttgtaagatattttaaaataaaaatgtaatacagtcagctttgtta

SEQ ID NO: 30591 - DNA, 439 bp, Homo sapiens
attaatattcataactacctggtgagttaggtaatactatctctattttataggaaggaaattgcatatcagagatgttctaacctcagtgtcaaacatggttcaatccatgtctgtctgagtccaagcttgtgtttttttatatcacaccctgttacctctgaataaaaatagaagtgatttactaagaattaggattatgagcatttttggaactagaaacaacgttgaaacaccatttgtttggttccactattgtagagacaagaaactggggtcccagaaaatttgtgatttgtgtaaagttccagggttgtttagtagtggggccactttgacaactgggcattcaattcctagtttaggtctttctaccacgttatacctgaggtgaagctaagtatctggtttatacttttatatctctaaaggagaaaaa

SEQ ID NO: 30592 - DNA, 840 bp, Homo sapiens
atgtagcatactttattttccgttccttagttgatggatatttaaagtgcttctaattttttctttttgctattaaaagtaccatggcaaagaattgagcctgtaatcccagctgcttggaagctgagaggtgggagtaccttgagcccagaagttagagtccatcaacctgggcaacatgatgtagtgagaggccaggtgcagaggctcacacctgtaatcccagcactctgggaggctgaggtgggcaggtggcttgagcccaggagttcaagaccagcctgcgcaacatgacaaaatcccgtctctacaaaaaatacaaatgtcagccaggcatggtggtgcatgcctgtagtcccagctactcgggaggcccaggtgggaggatcacctgagcccagaaggtgtcggctcctgtgggctgtgattgtgccgctgcactccagcctgggtgacagagcgagaccttgtctcaaaacaaaacatattgagaccctgtctctaaaaaaagacacagaaaaaaaaagaaaaaaaagaccttcgcaatgtttgcacaagtgcctgtgttcgatgactcttctcaaaggtggcagaagaagatgacatgcttggttatagggccaatgccctctaaacaggttgaaatcttacgaaggggatatgagccaagccaccatctcaccccaggctcagtaaccggcccttacagcccagcccattctctccttaatctttttgacacccacgtgaggtttatatttttttcatgtcctactctagctatgagaaaaccgaagtttacagatataactttaaacaagttagaaatagacaagcgga

SEQ ID NO: 30593 - DNA, 323 bp, Homo sapiens
cactgcattccagcctgagggacagagaagggccctgtctcaaaaacaaaaaccacaaaccaaacaaacataaaggatccacaaaagttctctagggacatagtcaaaaactggtccgaaataaatatccttccagtgttcagttttactgaacacatctcatggctttgggtttaactgaataattcctcactgggcacggtggttcatgcctgtaatcccaacactttgggaagccaaggagcatcacctgagcccaggagttcgagactagcctgtgcaacatagtgagaccaccccaccaccgccatctctaccgaaaa

SEQ ID NO: 30594 - DNA, 452 bp, Homo sapiens
ccatctctctgacgtcaccaatcactcgcgtctcaccacgctccactagagacgcgagcgtggaagatgtagtgaagtggatgaagtgagggaatgaagtgaaggcagactacgctttattacagaaacaccaaaagaactccttttgctctttctataaagtgcatgtgtgtctatataatttatcattatgtccatttgtgataaaatgactagctttccttgatacaggacaaacttgctgtgacaaagctggcacaaactgcatcgaaggattctgcaaaggaacctacaagccattctggcttgttcccatgaaattcacattaattatgctcctttaaatggaaaaaggcaccttaaagagatccaggctgaggctcatattatttcaaacccaaactataacagaatctagtaaataagagcatatatctgaaattatttggtag

SEQ ID NO: 30595 - DNA, 512 bp, Homo sapiens
agactgtgttttgccacgttgcccaggctattctcgaaactcctgagctcaagtgatcctcccacctcagcctcccaaagtgctgggattacagatgtaatccaccacacccagccaaatgcattcatgtctacaatagaaatacatctctttgctgctatcttgaatttgtagactcccacaaatcaataaaaaagaagacatccaataaaaaaatgggtagaggccaggcagtggctaacacctgtaatccaagcactttgggaggcccaggcgggcagatcacttgaggtcagaagttcaagaccagcctggccaacatgacaaaaccctgtctctactaaaaatataaaaattagccagacgtggtggcacgtacctgtagtcacaactactcgggaggctgagacaggagaattgcttgaacccaggaggcagaagttgcagtgagccaagatcgtgccactgcactccagcctgggcgacaaagcaagactccatctcaaaaaaaa

SEQ ID NO: 30596 - DNA, 752 bp, Homo sapiens
ttatcatattacataaaagtacctatggtctcacagatgaagggagtcagaagaaccaaactcccagaagacatataaatctaaatgccttttttactttagagtgaaaactgtaatagctaaattataatggacatctgctcattttctccctccatgtagacatggaaagctacacggaaataaccgagtttatagtagctaccatatattaaacgtttcctgtatgccagccactgtgcaaagcatattatatatattgtctcatttaatcctcacaactctgtaaaataagtattgtttgccccatttttccaatgaagaaaccgaggctaaaataggttgaataacttacctaaattcaccatcctcagaatactactttgaaatgagagacctgtactgtatctgttaattccaaattccctggcataaagactcagtacattgtttaaagagaatgcatgaagttaactgcattaccttttggagggttcatttgtgaatttggggccaaagtaaggggagttactggtattctaatagcatcaaacaaatgaattcatttcatcttttggggaggtggagggaataaggtctcaccttgtcgcccatgcaggctggagggccgtgatgtgatctcagctcgctgcagcctcaacctgggctcaagcgatcctcccctctggccctgaggaactttgaattggggcccaacaccgggcccggtgattttttgatgtttggcgggg

SEQ ID NO: 30597 - DNA, 776 bp, Homo sapiens
gcatattatatatattgtctcatttaatcctcacaactctgtaaaataagtattgtttgccccatttttccaatgaagaaaccgaggctaaaataggttgaataacttacctaaattcaccatcctcaaaggtgttaaagacaggattccagtacaggtctctcatttccttcatgattaggaatactactttgaaatgagagacctgtactgtatctgttaattccaaattccctggcataaagactcagtacattgtttaaagagaatgcatgaagttaactgcattaccttttggagggttcatttgtgaatttggggccaaagtaaggggagttactggtattctaatagcatcaaacaaatgaattcatttcatcttttggggaggtggagggaataaggtctcaccttgtcgcccatgcaggctggagggccgtgatgtgatctcagctcgctgcagcctcaacctgggctcaagcgatcctcccacctcagcctcctgagtagctgggactacaggtgcacaccaccacgcccagctcatttttgtatgttttgtagagactgtgttttgccacgttgcccaggctattctcgaaactcctgagctcaagtgatcctcccacctcagcctcccaaagtgctgggattacagatgtaatccaccacacccagccaaatgcattcatgtctacaatagaaatacatctctttgctgctatcttgaatttgtagactcccacaaatcaataaaaaagaagacatccaataaa

SEQ ID NO: 30598 - DNA, 939 bp, Homo sapiens
  misc_feature (74)..(74): n is a, c, g, or t
  misc_feature (297)..(297): n is a, c, g, or t
atggatggaggcaaccagagtgaaggttcagagttccttctcctggggatgtcagagagtcctgagcagcagcngatcctgttttggatgttcctgtccatgtacctggtcacggtggtgggaaatgtgctcatcatcctggccatcagctctgattcccgcctgcacacccccgtgtacttcttcctggccaacctctccttcactgacctcttctttgtcaccaacacaatccccaagatgctggtgaacctccagtcccataacaaagccatctcctatgcagggtgtctgacncagctctacttcctggtctccttggtggccctggacaacctcatcctggctgtgatggcatatgaccgctatgtggccatctgctgccccctccactacaccacagccatgagccctaagctctgtatcttactcctttccttgtgttgggtcctatccgtcctctatggcctcatacacaccctcctcatgaccagagtgaccttctgtgggtcacgaaaaatccactacatcttctgtgagatgtatgtattgctgaggatggcatgttccaacattcagattaatcacacagtgctgattgccacaggctgcttcatcttcctcattccctttggattcgtgatcatttcctatgtgctgattatcagagccatcctcagaataccctcagtctctaagaaatacaaagccttctccacctgtgcctcccatttgggtgcagtctccctcttctatgggacactttgtatggtatacctaaagcccctccatacctactctgtgaaggactcagtagccacagtgatgtatgctgtggtgacacccatgatgaatcccttcatctacagcctgaggaacaaggacatgcatggggctctgggaagactcctagataaacactttaagaggctgacatga

SEQ ID NO: 30599 - DNA, 411 bp, Homo sapiens
gtgccgtacctaagaaatcattgcctaaccaagattacatagattttcacctaagtctctttctaagagtttcatagttttagtttatccatttaggtctttaatctgttttgagttaattattgtatatagtgtgaggtggggtccagattcattttttttacatgtagacatccagttgtctctgcagcacttagtgaaaagggtattttccgtgtattgactttaagtgtaaagtttatttgaggactctcaattctattccactgacctatgtacctgtccttatcccagcaccaccctgtctcggattactgcagctttgcagtaagttttggaaattgaggaaatatgaatccttcaacttgcttctttctcaaaattgttttggctatttggagtcccttgtaa

SEQ ID NO: 30600 - DNA, 365 bp, Homo sapiens
ccaatattgcacacatatacagcagtgattcattatagtgttgtttgtcttacaaatatccttatattagaaaaattaggccttgtgtggtagtgcatgcctgtgattccaacactttgggaggctgaggcaggaggatcacttgaagcctggagttggagaccagcctgggcaacatagcaatctctacaaaaaaaatttaaaattagctgttgtggtggcatgtgcctgtagtcctagctactcaggaggctgaagcaggaggattgcttgagtccaggagtctgaggctgcagtgggctatgatcactcccttgtactccagcctgggctagagtgagagcctgtctcagaaaaaaaaaaaa

SEQ ID NO: 30601 - DNA, 2550 bp, Homo sapiens
acactataatgcctggctgtaaataatattttcataggcacaacatggtaaaagtgactataaatttaataaaatgttatctctaactattttgggagaatgaaagaagggaagaaaagggaagagggagaaaggtgcaataatatataaatagtaacattatcacaaaatatttaaacacaaggaaggaattcccaaaagaaatgcctaaaagaggtgaatgtggctgtctctgtgacattagacttggataagaaaaagcagggcactggcatttttcttatatttagctttttaaattatttacctctattactttgaaaaatattttcaattacataaaaaggatttcaataaagaaaagttatctaatgacataaaatctttctcaaatcagagatgagatctaatggtgttatctgcaaaataaattaatattaatgatgttttgaaggatacattgcaaaagacaaaacaagtaggcaccagactaagctgatattcatttcctgtgtaggcttcataaaattgtagtagacttcagttactagatacacaactgtagcagccactgtgaaatccaccagccactggtattctggaaagtaatgcaatgctggaaagaaaaaaaaaaaaaaaaaaaaaaaaaaaggtcaaaaaaaacagtttcacttacattttcataaataacttatgaggatttatttataattaaaatacgctagactttatttgttcatttgcaatgtaagatttacaaatatatgaatctaaaaatgcaagaaatagactgaggatgttagcatcccaaactaaattttaatacctcacaaattaaaataaacgttaaaagattaccaaaagttatttaagttgttggtaaagtatgattgcaaatttactggtattgtcttaactgattagctactttttacagaaattattagtaaatattttcttttaaatatctagctatgataccttaacttcagaaaacaacttagtctggaacacaacaatttagttatactgttcacttttgtgaagtaagagtttaactttatgttacaattattggctgtactaattgtaaactagtaattctgtgagatactacagattaaaataataaacaagaacagacgcggtggctaggtaaaaaaagatggtaacgataatgcagagaaaaaaacagaactttaaaaaaaaatcagatggctgggcgcaatggcttacacctgtaatctcagcactctggaaggccaaggcaggaacctggaggccaggagttgacaccagcctgggcaagctggggagaccctgtctctacagaaaataaagagagatgtgattgcaccactgcactccagcctaggcaacagagtgagaccctgtctcaaaagaaaaagaaaataaatcagaaattggattggcagctgcagttcttaagagtaagaatggaacttcaaagacaaaaacataattttcggcctggaattctattctcagccaaaggaaaaattaattcttagggtaaatttaaaatattttcaaaagcgcaaggtcacaaaaaatgtagttcccatgcaacctttttgaagatgatactggagaatatgctctgccaaaatcggaaagtaaaccaagtaggaggcagacatagaatatctttaaaagagctccaatttgagggagatgcaaagagaatctctaagaagatgacaatcagtgataccaggggcataggtgcacatcaggtgggaaggtcaaccaatctagactggggcttatctgagggttccaggaggaaaactctactcaagatgaaattgacatattacttgatacttctgaatatattaaggcaagtattcatctgtgaatggtgtttacatgatcataacataaacactgaatactgttctaaaaacatgacatcactatatgtggaagatgaaatgaatagaaactgatcagtggctaactgccagcccaaagatacgtgcttaatccttatttccaaagtgaaatggcaatagttaaagcttaaaactaaaatcaaggaatggccttgaaagtacatagaaatataaaagtaagcatgaaacagagaagagcaagaagaagttgcctctggagagatggaaatagagaaaagagtagggaacatatataattttaataaaaataagaaaacaaaaatatctcccagtagtaaaagacatgagttttcagatttaaagggtaaatctagaacttagcacaaggataaaatgtcagaaaccagaagaataaaaagaaaaaagcttccagagggtttatgtacaaggcgaaggataggtatacatgaaaagcaaaaggatatccaatttctcaagagacttcaaaattctgaagaaaacctatttctttcttagaattttctactgagccaacctatctatcaagtatgagggaaaaaataaagataattccaggcaagcaagatttcaaaaaacaatttagcaccctttctaaggacaccataggagaatgtactctgcactctgc

SEQ ID NO: 30602 - DNA, 840 bp, Homo sapiens
ggtctcgctctctgtcacccaggctggagtgcagtggcacaatcatagctcactgcagtctcgaactcctgggctcaagccatcttctcacttcagcctcctgagtagtaggaactacaggcatgtgccaccatacccagctaattttttttttttctggagagacagggtttcaccatgttgcccaggctggtctcaactcctagtgcttaagtgatccacctgcggtggcctcccaaactgctgagattacaggtgtgagccatcatgcacagcctccaagatccttatttaccagccaggcgttcatgctcttagagcctcaaccccacacggtgccttctcaggtctccaacacttgcctgatcagataccctctcctgtgacccccttcttcctcttctctggttttccaaggcctcctggttccctgacacccacctcagcccagcccttcccaacattcttgcccttgaactcctcaaggacattctgccaagtcctgttgccaggcctggagttactctctccctcccagccccactctgctgccatgagcctaaccttccccttacctggcccagccatggctccagggcaggggctgggcctcagtgtccctgtgtgcccccttgaaatgtggtacacagtcccaaagcagcaggaggttaaaaaaggaaccaggaggcccgcagcctggccccgaatccctgcgctgtcatttcagactagatgacctcaggcaattctccccgaatccaccccacccctgccagttctgtgcctccctctgaaaagtggggctataccacccccgcctacctgctcacaagtgagaat

SEQ ID NO: 30603 - DNA, 458 bp, Homo sapiens
agaggaggggagaggactggggagccgagccagagccgggctgcctgccacccggctgctcgtccgctagctggggaggagcgctccacccgcaactgacaaaggatgggagaatgcccgcgccccgggatgccggccgcacgcagcctggcggccgcctgagctacttcaccctccgccggtaagtgactgcaaacatcattcattcaatcagcctcactgggagccccttctctccggctggtagtcctgggcggcttgtccctgatcccgagcggggcttggcacagcatcagccctggagggcaggcagcaggtgcctttgcctggtgggtccactggggagcgtggctggggttcgcggcgggtgctgccacccaacctgcgggcggcgggctcgcccagtaggcgcctctctggtgagaggaggcggctccagcccgcagcctggggtagtt

SEQ ID NO: 30604 - DNA, 250 bp, Homo sapiens
tttaccgcagcatctgtgtctgaaagccaaaggagagagggaaagtagaggacagagaaacatgttgctttattctggcagcctcatctccttgcccttggtgacagcaggagggcactgctcctgctcttggtctgtggcaagcagaggatgaaagcaaaggaggatgctttctatggtgcttcagctcactgccaccaggagagcccttcccagagattgttatctgagaaatgagctgtataatcta

SEQ ID NO: 30605 - DNA, 449 bp, Homo sapiens
ataataatagaaataaagtgcacaataaatgtaatgcgcttgaatcatcccaaaactccctcgcgcccgccccccgccccccaccaccatctgtggaaaacttgtcttccgaaactagtccctggtgccaaaaaggttgaggatcactgttctaggctatgtgtattctgtggttaggaacccatggaagagatattttagcagtttcaggaattactaaataccactgagaacttatattaaagtaatacctcatctctctagggaatacaattaggtacagatactttgggttggatcaggtcagttttaacatccaaaatattatttttaaagcttttttagtatcaattaaaatttttgttttttttaaattacagttatacatgcatagttttaaaaactaaacatttcagtctgggcacagtgcctaacacaaacattatggg

SEQ ID NO: 30606 - DNA, 442 bp, Homo sapiens
gaaaactgttggtcctgatagatcccttcctgttctttcaaaagtcatatccagtgtagatgagtgccccaatgcacaggaaagtgctaggagaaataaaacaaaaaactgctgtcctgtgaaatagtaatatttttcaatagctagggaccacgccttgctgatgagggaagccaggctgaactgagcattgtaaacagactgtgacaatctaccggaagaaaagaagggatgggaggaatcagtaaacaagattcaaggaatgggtaaatctttcattaaatactatggactaaacctcctcagtggagcgactagcaatatttcactgaaacaggtagtgacaatatgcaagcagattgctttttatccaggatggaattcagaaacctttgttttccctgttctctgacatgtggcactttacttaactaggaattta

SEQ ID NO: 30607 - DNA, 619 bp, Homo sapiens
gagtaaactcagaaccatttcaacacttcttttgggattttgtggcctaactcagacgagtgtctcccagcacgtccttgggaaggcaggactgctttcagactgcagctgaggggttggagctgacttacagggctatttcgggatctgcagtggaaccaaggttggtgggcctgccttcaggggggatggactggggtatcttccaggagatccctgggcagatggttcctgtgtcaggagagccaaacaaggctgccattgagtccatagggggatgaggccatttctggatctgcaaaggaccccatttggcgagctgcaacctgggtgcaaacctgccctcttaaaacagcccttctcagttgggctccatcaggatttcccagcctcctaccagagtcctgaggctcccacgaaggcacttttgtgtgtggatggctgccaaattcttgttgcaatgggtggctaaaagcagggggtcccctgttctgccatcttgctgacattacttccattgggaggctgaggcaggagaatcgcttgaacccgggaggcagaggtcgcagtgagctgagatcacaccactgcactccagcctggtgacagacagatactc

SEQ ID NO: 30608 - DNA, 315 bp, Homo sapiens
gtcactgttattttctatgccaagcatttgacaactgtgactatcccctactttctaagttgtctgtccttttttcttaggttcccacttagactataaatttcatgaaaataggtcatgtgtccccattttcttccttaagcaaaataaaattatacaactttagggctgaagagatcacagaaactctctgataccatagccttcccattttttctcctctccctttctccagaatacatcagttgtggcttagagagggggaagtagtcacccagtgacaggaagaaagctagaactgaagtcttctgagtt

SEQ ID NO: 30609 - DNA, 480 bp, Homo sapiens
  misc_feature (104)..(105): n is a, c, g, or t
  misc_feature (115)..(115): n is a, c, g, or t
  misc_feature (118)..(118): n is a, c, g, or t
  misc_feature (123)..(124): n is a, c, g, or t
  misc_feature (144)..(145): n is a, c, g, or t
  misc_feature (155)..(155): n is a, c, g, or t
  misc_feature (162)..(162): n is a, c, g, or t
  misc_feature (164)..(164): n is a, c, g, or t
tggacatgactacaatgtgtccccacatggcacctggctgcttgggatttgtgcatggctgatatggtgggatctctggttttatttttcccccgcatctcttnnatctcttccntcnggggnncactcctctcttctcttgannctgtcagtcnccggacngnccctcatgggaaggcacctgaccccggctggcccatatttgcagagattgatctggagtgggcatatgatcaacccggacccatccaaatcctctcctgggctttttttttttttttttttgacagagtctcactccgtcacccaggctggaggtgtttcttccctgacccttcccctgcctaccctggccactgagaagggctgaacaggagctaaatctggagggtacaaatgttatttcccttgttctttaagattaccaccaaaaagggaaaagaaaaaaagccccacaataaactactctctgatttaccc

SEQ ID NO: 30610 - DNA, 300 bp, Homo sapiens
attggtagagaactttgaactggaaagaaccctaaagaaatctcctgtctacccctgttattacagattagaaaccgaagtccaggaaggttgagcaggcaagtctccaggctgagttcctgatgtccaggctggaggtgtttcttccctgacccttcccctgcctaccctggccactgagaagggctgaacaggagctaaatctggagggtacaaatgttatttcccttgttctttaagattaccaccaaaaagggaaaagaaaaaaagccccacaataaactactctctgatttaccc

SEQ ID NO: 30611 - DNA, 172 bp, Homo sapiens
cagaaacaatgttaaggtcaaaatcatggagctcttgccaagccatcagacttgatattcactggaatatcttaaggaaggacaactaatgaaaacagctaacaattctgcagcacttgctacacatcatgccctaagagtttcgtttatgatcatggtatctccccaccag

SEQ ID NO: 30612 - DNA, 351 bp, Homo sapiens
ccaggtttattgtggtttttcttcaaacacagtccataactgcagaaatggcatagtgcaagtgtcaaaaacattgataggaagcccttcatcattctagccagaagaatcagggaaaggagcccagacaacaaacatcactgagaagtgagagagaaattccagaaggaagagacccagagaagataatccccaaattctatctaaaccccacacgtctccgactgacctttgattcacgtatatgcaggacaaactcaaagtagcacagtaaaggcttaaagagctgaactgaaccaccaaccacagagtaagacaagacttacagtgagtttaactgactggtgaaat

SEQ ID NO: 30613 - DNA, 409 bp, Homo sapiens
gcagccaaaagaaaggaataaatgttagaaatattagcaatagaattaaaagtcatgggaactatttgaaaatgcagcatgaaggaagaggtaaaggaagcatcaaagacaattcaggattctagcttggatgattggttggatgttgatatgtaaccaaaataaggaatgtaggtaaaaaggaccaggtttgttcggaaaaagatggcggtcaggatttggacctgttggggtcaaatttggctacactgaatttgaggtctctgtgagttatctaagcagatatacctaataggcatcaggtaatttgggtcttttcctcagaataaagaatataaagatttgggagccatcagcatttgaggtaatacctatccagcacatcagtgagctaaggagaataagtata

SEQ ID NO: 30614 - DNA, 439 bp, Homo sapiens
tgagtttaacagtgccaaatttaatgacagttacattgtaccaagtcagaccattttagagaaagatgcctgcagctgctgagttactgtttcacaacaaagattcttactaattagctttcagccaagatggcctacctagagaaacttggcacagcctttctgtatggccctgggaattctggttggctttggaaaaaacaaagcttgactttggtggctcatattgaaaacctcatcctattagaagtcttaactatttttttaagacagggtctcgctctgttacccaggctggagtgcaatggcataatcatagctcactgtaactttgaactcccagcacattgggaggtcaaggcaggtggatcacttgagcccaggagttcgaaaccagcctcggcaacatggtgaaaccctgtctttacaaaaaatacaa

SEQ ID NO: 30615 - DNA, 469 bp, Homo sapiens
ggggacaaactccaaagaattagcccaggatactcagtaaacaaaacaaaaggagaaaaatggcaacggcaaccatggcctggaaggtagaaatcagaatccacagctgctacagtgtatgatctaaaatgttcagtgttcaacaacaaaacaaactgaggctgggtgaggtggctcacgcttgtaatcccaacactctggaaagccaaggcaggaggatcgcttgagcccaggagtctgagaccagcctggacaagataggaagaccccatccctacacgtatgcatgtgtgtgcacaccctcgccaaacacacaaagctgggcatggtgttgcatgcctatagtcccagcaactcaggaggctgaggcaagagaatcatttgagcccaggaagtcaaggctgagaagagccatgatcctgccactgcactctggcctgggcaacagagtggaaccctatctcaaaaa

SEQ ID NO: 30616 - DNA, 3729 bp, Homo sapiens
  misc_feature (2)..(2): n is a, c, g, or t
  misc_feature (163)..(163): n is a, c, g, or t
  misc_feature (168)..(168): n is a, c, g, or t
gncgtccgcgcacacctccccgcgccgccgccgccaccgcccgcactccgccgcctctgcccgcaaccgctgagccatccatgggggtcgcgggccgcaaccgtcccggggcggcctgggcggtgctgctgctgctgctgctggcgccactgctgctgctgcnggggncgtcgccgggtcgggccgtgcccggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcagatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccagctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcacgggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagaggggagggaaggagacccctgcaggctccctccacccaccttgagacctgggaggactcagtttctccacagccttctccagcctgtgtgatacaagtttgatcccaggaacttgagttctaagcagtgctcgtgaaaaaaaaaagcagaaagaattagaaataaataaaaactaagcacttctggagacat

SEQ ID NO: 30617 - DNA, 434 bp, Homo sapiens
ggttttcacgcatgcctcactgtcctaaccagtcggtccctgtggggcctgctagctcttgcagctacctccatgctcatccctgaggcccagaaatcactggcagcctcactttcatgtctacttgactgctgtctccccatgacagtacacagagcttatggaggctaacaaagcttccagggtaccagagaagaaacagggtacatgtctccaaacctgaatagacttcgtagtgggcaaataatggtcacccaaagatgcccacatcctcatctctagaacctatggctatgttgttacatggcaagggtgaattaaagtatagtggaattaagattgctaatcagctgaccttgagataggaagagcgtcccaaattatccaggtgggtccagtggaatcccaagggcccttaaatgtggacgaagcag

SEQ ID NO: 30618 - DNA, 446 bp, Homo sapiens
gaccataaacagtatcaatgtatcactgaggccaccgaaaaggacatttctacctaggcaatcagtcagattcacagaaaaaagttgtttgttgttgtaaaggctcaagatgaaactctttccccagcagtttagtgcctgctgaaaagatccctgatggacaatacttcttggtggactccagctgccccttttattattattagagacaaggtctcactctgttgctaggctggagtgcagtggcacaatcatggctcactgcagccccgaactactgggctcaagccttcctcccgcctcagcctgcccagtaactggtactacagatgtgcacacctggctaagtctttaattttttcgtagagatgaggtcttgctatgttgcccaagctagtttcaaactcctgggctcaagcgatgctcctgcttcagcctcccaaagt

SEQ ID NO: 30619 - DNA, 706 bp, Homo sapiens
ccctacctcatgcaaaatacaaaaattaactcaaaataggccaaagactcaaatataagggttacactataaaactcttgggaggaaatatagaataaatttttgtgaccttgaattaagtattagatttttaattcttacaccaaagcacaagttaataaaggaaaaaaaagataaactggacataattaaaattgaaaaaaaatttgcttcagtgaacacagtcaagaaatttgaaagacagccacagtgcaagattatttttgcaaataatatgtctcataaatgacttgtatctaaaatatataagaccaggcatggtggctcatcctgtaatcccagcactttgggaggctgaggcagggggatcacttgaggtcaggagtttgacaccagcctggccaacatgatgaaaccccatctttactaaaaatacacacacaaaaaaaattagcagggtgtggtggtgtatgcctgtaatcttagctactcaggaggctgaggtgggaggatagcttgaacctgggaggcagaggttgcagtgagccaaaattgcaccaatgcacactccagcctaagcaacagggcaagacgccatctcaaaaaataaaacaaaataataaaataaaataaacagtaattaccgctaaataataaaacaaacaataaaccaattttataacgaaaggatctgaatagattcttc

SEQ ID NO: 30620 - DNA, 719 bp, Homo sapiens
accaccctcatcatcagtatctttggtctgtgagctgcaggtctggcaggggctagcatgggctagggcaccacagccaaaggcttgggtctcacttggactatttgaccaagatcagcgggtgctaagtggccgctggcgcctcccacttcgggcccttcctctggaccccagccttagccttgggcagctgaatgggattcctcaggcaggtcaggctgagctctttctgcggctggtgaatgcaagagatgcagctgtacagacactggcagagatcaatccagcaagtgtccatgagtaccagttacccacctccggtgtccagcacatcttcactggaagccaacttcctcacccccgcagttggctttgctgatcccccacctcgtacagaagagcccctcagtggagtcaaggatagagatgagggtttgggccctcaccacagttctgacttgcccccagtgagtttctgaacccaagtgaatgtggagatgagcatctgaacatgcacaggactggggcctatttccagacctacagctttactactccatgttctgacattggatctagaagcatctagcagttgagtacagaaaaccagttccaaccacagctttaccacctcccgttaagtccttaacttttctgtacctcttctgtttttgtaaaacagattaaggattaaatgagtttgtcaggtaaaagagata

SEQ ID NO: 30621 - DNA, 505 bp, Homo sapiens
atgcctctgcctctttgactaattccacttctgagactctgccccaaggaaataacccaaaaagctaattggttccaagatgttccaagcactgctatggctaacagtgacaaacagaaaaagacccaaacactcgacaattcgaagatggcccagaaaaccgtcaagtattaaaactgagcaaaacccaattccaggaacattaaaaatgccagtcacgtggatgcttagaagtttatcagaaattaacgggaagaaatgagaacagaaagcccagctggtcgtgtctgcacaagctcacacacaccgaccacactcaggataggcaccaaaaccccccttcccctcgcaaaccaaggtccttattcataaaacacaaatgtaatcctagcactttgggaggctgaagtgggaggatcccttgagtcgggaggtcgaggttggagtgagccaagatcatgccacttcattccagctcgggcaagagagtaagactcgtgtcaaa

SEQ ID NO: 30622 - DNA, 351 bp, Homo sapiens
gtcattggctgggttctctccactgcactagctactgtcttctgtagctggtgtgagttagtgttagagtggatggattaaatttattaagagggccagtcagcaatagcacatggtgtacagggaactttggacagggtgagggtcctgctgtttcaaaaggcaaatcctatgaggactatgaatcatgagtttgagtctgatttatttttttaggactggaaccaacataagaattgacaggtacattaggcaggatgctccggaaaatatataaaatatatattaacaagaatttactgtatgataaaggtggtttaacaactagtgagggaaagaattattccaaaa

SEQ ID NO: 30623 - DNA, 449 bp, Homo sapiens
gattgagagtatcacccctgcagtatttaggtctttagtggtggtactaatctccacccttccccaggatgtgaaattagttttgatttacactcttggccatggaggaatgggagttttaaaggcttctacttaacctttcccaccatgatagtacttatcccatagccaaggatccgatgtgggagttactccactgtgtacagtcacccaagtaaatggtcacgggtctttttgaagaaggattagaagagacatcgcagcatattctggctgcagtattgcaaggtccttcttcctgggggtccagccactcttcagtcagtgagctctagttttgaaaactggctaagatccaagaacagaggaagaacttttttactggagaatcaccttcatgctcctgctgttctattcttatcttctgattaaagatgttcagcagcacg

SEQ ID NO: 30624 - DNA, 822 bp, Homo sapiens
tgtctttcttccttcttccagcctgcaacttggaggtgatagctggagcttcagcagctattttggaccatgaggttaccttgaggatggaagccatatgtgaagatgatgcaacagaaagagaggaagctggattcccactctcactctggagcaaccatactagcctgaaactgctacctctgggcatcttttatatgctgggaaaaagaaacttctatgttgttaagcctctgttgcttagggattttccatgtgcagccaaacagatacaacagcaaatggggaaagcttcacagggctttcaaggagacaagaggccactcaataaagaacaagactcctttttaaaatatttttcaaagacagtaaggaatctgtattcaaggggggaggctactacgatgaggttttgtagtaggggacagagatcagggttaactcccaagattccttttaataaagccatacctagttctcactggtaaacttttcctcttgcaagaatatgaggatgatcccagaaatgcttccagaagaaaacaaataggatactttgaatgcaacaagggtcagattggctaaaggtttcacataagagactctgaactttaaatagatgtcttgaaaataccaagggaaaattatgcttaaacctagaatcacaaatgccaagttttctttgacatttaaaggacacaaaaaattttgggtatgtaaggacaaagaaagtttttcagatcttttctgaaagaattactctaggttatatttcaggaaaaaaaatccaagaaagctgaaatactgaggtaaataaacctg

SEQ ID NO: 30625 - DNA, 436 bp, Homo sapiens
gatgggcatttcagaatgtgggctcctaaaaccagcacttgaaatacttccaggaatgccagccagaacagaaagaccactggcagcaatctccaaagcacactcaaaagatccacaggtggccagatggtgccatgacacagccaaggcttccccaagggccccaggatggaagaaaataccagggctctgtcagagacaagcctgcatctgccagtgtaaagaacctttcctagccaagttatgacaatagtcatgggaatacgttcctgtcttccactgcctttcctcagatgtgcacctaatgtccaagaggagatttattgcaaatgccttcacagtcatcaggatagagaaggagtactcagggtctgggctttgcttttctcttaagaggaaactctgttagaaataaaaaggtctacaggatattgat

SEQ ID NO: 30626 - DNA, 459 bp, Homo sapiens
ccaagcctccagaaatgtaagccaataaatttctgtatttctaaagttaccccgtctcagctattctgttacagcaacacgaaacaaactacaacaatatgaatttttaggaatcagtattttctcctacaaagtctaaagaccaaaagagaatgcaaatggtcagtcttaaaagctcttccctgccgggcacagtggctcatacctgtaatcccaacactttgggaggccgaggtgggcgggtcacctgaagtagggagaccagcctgaccaacatggagaaaccctgtctccactaaaactacaaaattagccgggcatagtggcgcatgcctgtaatcccagctactcggaaggctgaggcagaagaatcccttgagcccgggaggcagaggttgcggtgagccgagatcgcaccattgcactgcagcctgggcaacaaaggcgaaactcagtctc

SEQ ID NO: 30627 - DNA, 381 bp, Homo sapiens
gatcatccagttaaccttctctgcccacccactttatggatgaggacgctgaggcccaaaggaggcacttatcaacacaggaagataaagccatcaaaagagccattgttggccaggcacactggctcacgtctgtaatcccagcactttgggaggcccaggcgggcggatcacgaggtcaggagttcgagaccagcctggccaatatggtgaaaccccatttctactaaaaatacaaaaattagtcaggtgcagtggtgggcacctgtaatcccagctgcttgggaggctgaggcaggagaatcacttgggcagaggttgcagtgagccaacatctcgctactgccctccatcctatgcgacagagtgagactccatctc

SEQ ID NO: 30628 - DNA, 397 bp, Homo sapiens
tttgttcttaagcgaggaaagagggttacacacacatctgtctcttaaagaattctcaaaaacagtcagttctgggctgcactggaactctactgttccaggaacatgggcttccatttcctactctgcggatctcagctatggcatctacctcttagtccaggagagttactgaagttcttgccatctggatgattctacccaagtaggcagaggaggggatgaagtggagcctgtctttcccttatattccattgggcagaatttaatcaccaagccacacctacaagaatggctgggaatctcagccttcagtctgtgtaaaaatgtgcctaattaaatttacgggttctattaacaaagaggagaaagggtatctgagacacctagaatctga

SEQ ID NO: 30629 - DNA, 698 bp, Homo sapiens
gaaactgttggtagatttatataatggtctactatatagcagtgaatgaatatcctagtgctctgtgaaacaacctggattaatttcagtgtcttaatttgtacacccccagaacagagtgtgaggtgtgagacaagtacttcagttcaagagtgtatttaggaggtaatcccaggaagcagaaatgggaatgagcaaaaaaggaagaaaagtcaataaaaggtgcagtacggagctacttaccactatgaaccaccgtgctcactcccattgggaacactcagaggaatcatgtcgaatacagctcagagctgaaggccttcctgatgcgcttgcctgctccctggtctctctgcatggggaaggagtgttcccagcttgcaaactccagctttgcctgtgagaggaacaagcgtccctgatccagaaggtggtgagtcctcctctctctcttcatgctttttagtcctttaactttctcaggatcctcaggtttagtagagaaataatcccctttctccttacgcacaagaacattttcaagggtgaaatggggcagttgttagctatcactaaagaaacacaaaaggagacaagtgacaagattgctggatgggttttgttgaagtactcttatttaagtagtattgtcatcattattaaattaaagccaacatttatttagctcttactatttg

SEQ ID NO: 30630 - DNA, 707 bp, Homo sapiens
ctgacatggaaagcctagagcaggacggcaaggcagagcgaactctgtagcaacctaaaaagttggcagtcaggtacaaagtagaaaaagatctcacaaagtttggaaaggtggcaactccagtgtaaaaaataagacatctcagaaatttcatgagggccaaatgtcaaactctgctggaagggaaagtattgatgccaccctcaaagcatggaaagccagtgatttactgaatgtaacaaagctcagagatgatcaattacaaattagattgaccctgtctcacacactaactgcttgagaaaagagcacatctttaccagaggtaaatacattactgcagcctctactctttacacaaaaagttacagcatacctcaaaaaaatgatgagatacacaacaaagctagatatatgacccatggtcaagaggggaaatggtcaatagaagcagacctagagatggcccagatgttcaaaaatgcttagctgttatttcttcaaactacttctcccctctatcctttccacttgggactttaattacacattaaactatttgatatcataccacttattcaaaaagctcagagaacccaagaaaaataaatgcaaagaaaacccactttgggaggccaaggcgggcagattacgaggtcaggagatcgagaccatcctggctaacacggtaaaaccctgtctctact

SEQ ID NO: 30631 - DNA, 509 bp, Homo sapiens
atgtctgtgttttgtcttgtgggccttggggtgcccctgcccctgataagaaggggtttcagagcagaaataaagcctcagacaggtgagcctctgtggcacatggcccctcgagccagccatgcatctgggttcagcccctgccaggacacttgaccaggccccttaccttctccgagctgggatcatgctgggaagactgaatgggacgcagccggtgaaaacgcctggaagagagtaaacgccattttctctaagcatatttatttctttaacaacagtgacgaccatttgtgagccatctctctgtctcaggcacggtgctacatgccaacgaaacctgctcccattgaaccctggccagccagtgaagaaagggttgggcctgggaggtgccactttacagacaggggcaccaaggggcagggtggcaggaggcccaccggacgttccccatgaagtagcagtcccagcatccacacccagcaggcaccacgctggcccgcagc

SEQ ID NO: 30632 - DNA, 400 bp, Homo sapiens
ttttttttttaaacgttttcgtagaaatgagggtctcactacgttgcctagtctggtccagaactcctggcctcaagtgatcctgttgctgtggcctctcaatgtgctgggattacagacagccatgaaccaccaggcctggccaactttcgataatgtggttagataattcaaacttaaagctgttggaactttaaattattccaagccttgagaggaatgttgctatgtagcctgagtcacgtagcatgcagttacaacttctgctttttcctgtaaatgattaagaatgaccaagcagtgccagagataagatcacctcagaacattactcctaggccgggtgttgtggcctcacatctgtaaccccagcactttgggaggcagaggtggatcactt

SEQ ID NO: 30633 - DNA, 366 bp, Homo sapiens
caacaaaaccagatcccatcactacaaaaaattatttcaaaaaatttgaataaaataatactaataaagcctaatacaaacaatacaggatgcagtggctcacacccgtaatagcactttggggggccgaggcaggcagatcacttgaactcaggagttcaagaccaggctgggcaacgtggcaaaacccctctctacaaaaaaatacaaaaattagctgacatggtgtggtgtgttctagtcccagctactccggcggccaagacggcagaattgcttgagccgtggaggtcaggtctgcagtgagctgtgattacaccactgcactgcagcctgggtgaaagagtgaggccccatctcaaaaga

SEQ ID NO: 30634 - DNA, 465 bp, Homo sapiens
gggtccaataaaaatagaaagaatgaataagatctagtattttataacataactttaggatacctaaagaatgaataaaatctagtatgtgatagcataactttaggacacctaaagccaataataattgtacatttttaaaataactaaaactgtataattggattgcttgtaacacaagggataaatgcctgaggtgatggatacctcattttacatgatgtgattattatacattgtatgcctgtatcaaaacatctcatgagatgtattttcccattaaaaattcctcattaaaaaatgtcatatatcccataaatgtatgtatatatatttacgtaaatatatgtatatatatattcagtgtaattctgaaacattttaattatgaagatttatcatggtcatgacattgctttaatatactggtttcatataatttatttaatttggaattcctaataa

SEQ ID NO: 30635 - DNA, 384 bp, Homo sapiens
ggataactccaaacatatcatgtgccacagccttttaaacatttttatcgttgaatgtgtaaatagtaatgttttgaaggtttccagatttctctccagattgtgctagttaacttcattctgccgtcatagaacaattaaacagaagcatttgggagaggaataaaaaaagtgccagggaggaacattgtaagtcagacggcaggtgcagaagtgccctggaaacctgaggcagaaactcacctggccgcacagtgcctgggccttccaggggtggctccaggtgggtggaagcaccagtgtctgagaagctccggaggctccacagactgcagggcagccctgccccagagagtgagtgacttacgtccaggagcggcccca

SEQ ID NO: 30636 - DNA, 136 bp, Homo sapiens
aaatattttatgtgcacttaaatgtataagaaacttaccttgcactgggaacatacaaaaatgaaacaagacaagtttctcattctgaacacacggtattgagcttgcatgactcacagtgtgcaaattgtatagc

SEQ ID NO: 30637 - DNA, 413 bp, Homo sapiens
tgggcaggtggcctgagtcacctactgtgtgtgagctgggctcaccatggcaacccagcagacccagagggcataaagaagccagtaccttccctgctgcacaagtgtaggcggagcatgttgcatctgctttgatttccaacttagaaaagtttttctctactttaaggactcatttccccttcccttctctcaggacacagcttactcactctggggtccttctccttgcctggaaggtattctgcagtcccacaggcaaaccccactcatcccagaattaagtaccacctcctccaaggattcatcccagaccagttagtcctctacccttcttcaagttcccaccacacaaaaggcagaagctcttaaccttcagaatctgtggcttacacactgacaatcaactgtgt

SEQ ID NO: 30638 - DNA, 379 bp, Homo sapiens
tattgctactatagtggtaacctaggttataattttcaaatgtaagagccccaaatactattctttttactcttagtgatatgaaactatgttagaacatctgcagaaagtctgaattagtaattttaataataaatattgagtactgatatattgtatatcactgagatttattttatatacattattttatcaattcctatgatcacttcggtaagtactaattttcacaactaagtagtgacagaaaatgaggtttagagagatatagtattttacccaaagtcacagaatataagtagagaatgcagaacttgcattctgggctatttgacagtggagcccagacttttaaaattaggcttataaagatttcctg

SEQ ID NO: 30639 - DNA, 346 bp, Homo sapiens
ctgaccccttccatttgcccttgactctaattggtccactacaaactattttttacctaatgtagacctccaacctgtcaatccatcaaacttttccactgtccagcctccatatgctatcttcatttctctttgtacacacttaggctcacaacccattatttatccagttttttgcaaacaatctcctggactccctttttttcctctctcccttcactctctctatctgagaacaccttaatttgggttgtaatattcttaagtattttatcttgcaactatcccttatttctctgaaacgttagtctccatttctactgaattatccccatcagcttgtcaa

SEQ ID NO: 30640 - DNA, 4047 bp, Homo sapiens
aaaaataacagccgtatgcctctgctaagtactaactacctcatcaccttttgtgcagacaggcaggttacatttggtttaaggaattaggaatatgttctttccagcaccttagtaacccacgcgattgtgattcttttctcttcttgactgtgataggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaatta

SEQ ID NO: 30641 - DNA, 641 bp, Homo sapiens
gaaaaaagagccgcccccatcccgcccgcatacagcccgcatcccgccggggaagcgagcccagtccagcgctgcccgtccagtcctcgcccaagatttaaagcccgcaagttttgttcttgagaccagcgactttagctccgatgcgggaaggaaagccgacctccgatttggacatttaaagagctgggcttgaacttcgtgagtttcgctctaaactgcccttgaaatgaagctggacttggaggtaaagtcactgggaagctggcctggggcggggtttccccctcttctcgtattttagaaacggacagcggcagtgcagccctagtttgctgtaagtttccttactttgttactgaggcccccagagctccacgcataagtggtgtgaccagaaaccttttaacaagacccgcctgagcctgcgttagagctcccgctcggaaagtaaaagaccatcctaatccgcggcgctgcggaaccggtgtcccgtgtgggaggaaccgcggcgttccctgggcgtagggcccgcgaggccagcacagtccgcctcttggcggagcgccctgggccggtggttccgcgcggagttagtctgtggtcagttacgtggtgaaaacacggctgtgccgcggccg

SEQ ID NO: 30642 - DNA, 4110 bp, Homo sapiens
tgcacccacagcagtctgttgtggatggttgctgagctgcgcattcggcattgggcttgctttgtttcctgccaggcccagcattttcttctaccagatcggcaggcttgtgggcttcttcctaggtccctcccctgcactctgaataggaaagctggaagctgtgctttagagaagctttaagacgccgaaagaaaccagaagagtgagcgccagttgtatgtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaatta

SEQ ID NO: 30643 - DNA, 4135 bp, Homo sapiens
gaaaaaagagccgcccccatcccgcccgcatacagcccgcatcccgccggggaagcgagcccagtccagcgctgcccgtccagtcctcgcccaagatttaaagcccgcaagttttgttcttgagaccagcgactttagctccgatgcgggaaggaaagccgacctccgatttggacatttaaagagctgggcttgaacttcgtgagtttcgctctaaactgcccttgaaatgaagctggacttggaggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaatta

SEQ ID NO: 30644 - DNA, 4003 bp, Homo sapiens
tgccggccgggggccccaggcttgcggccacccgcctccggctggagggctgaattcgagtcgaaagcccgtgtcgggctggaaagaagaaaccgccaacctgagaacgctttcggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaatta

SEQ ID NO: 30645 - DNA, 4179 bp, Homo sapiens
aaaaataacagccgtatgcctctgctaagtactaactacctcatcaccttttgtgcagacaggcaggttacatttggtttaaggaattaggaatatgttctttccagcaccttagtaacccacgcgattgtgattcttttctcttcttgactgtgataggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaattaaaaaaaaaaaaaaatgtggggggggctgggccggagaagtttaaaacacttggtgggggggcccaggtgaggaaatgggcaagggccaagaaccgggagaagggtggtttccaaaaaaggcggaccgggttg

SEQ ID NO: 30646 - DNA, 3994 bp, Homo sapiens
aaaaataacagccgtatgcctctgctaagtactaactacctcatcaccttttgtgcagacaggcaggttacatttggtttaaggaattaggaatatgttctttccagcaccttagtaacccacgcgattgtgattcttttctcttcttgactgtgataggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaatta

SEQ ID NO: 30647 - DNA, 2550 bp, Homo sapiens
ggacgcgtgggtcgacccacgcgtcggattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaatta

SEQ ID NO: 30648 - DNA, 3640 bp, Homo sapiens
  misc_feature (3614)..(3614): n is a, c, g, or t
aaaaataacagccgtatgcctctgctaagtactaactacctcatcaccttttgtgcagacaggcaggttacatttggtttaaggaattaggaatatgttctttccagcaccttagtaacccacgcgattgtgattcttttctcttcttgactgtgataggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgagacaaaggnacccgggatcctctggtcgcccccgg

SEQ ID NO: 30649 - DNA, 3555 bp, Homo sapiens
aaaaataacagccgtatgcctctgctaagtactaactacctcatcaccttttgtgcagacaggcaggttacatttggtttaaggaattaggaatatgttctttccagcaccttagtaacccacgcgattgtgattcttttctcttcttgactgtgataggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtaatgatctaaaaccctgtatctactctgaaagtaactacaaccaagagtg

SEQ ID NO: 30650 - DNA, 1283 bp, Homo sapiens
tgcacccacagcagtctgttgtggatggttgctgagctgcgcattcggcattgggcttgctttgtttcctgccaggcccagcattttcttctaccagatcggcaggcttgtgggcttcttcctaggtccctcccctgcactctgaataggaaagctggaagctgtgctttagagaagctttaagacgccgaaagaaaccagaagagtgagcgccagttgtatgtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctgtcgacgcggccgcgaatttagtagtagtaggcggccgc

SEQ ID NO: 30651 - DNA, 296 bp, Homo sapiens
gagctggagctctggacacttttgctgggctacctgctggaagccaggggacctaggttcctattgctgacgtgccagtgatttactgtgtggctttgggtaagggaccttttcccttctgttcattggagtttgtccctgtgcatggggtggggtgggcagtggattagatttcttttgtggtttaaggcactctccaatcgaaaatgcaaaccgtatgtataatttagaatattttcatagccgtatttttagagaagggacacaagtgatattttaataaatttatttgaccc

SEQ ID NO: 30652 - DNA, 353 bp, Homo sapiens
atgctaaaagagaaaaggaacaagtttctaagctcgaaaagctgaaagtcagttgttctattatgtaaattcagtgtgaaggcagtgggcaaccagtcaccctctcatggggagaccactactagggcataatttttacccaaatttctgtagttcctatagataaataacttcagcacttggcctttaatagtgtaggggaaggaggtcaggcgtggaggctcatgcctgtaatctcagcactttgagaggccgaggtgggcagatggcttgaacccaggagtttgagaccagcctgggcaacatggtgaaaccttgtctctgggcaacatggtaaaaacctgtctctacaa

SEQ ID NO: 30653 - DNA, 411 bp, Homo sapiens
cccctgtgcagcctgcgtgcctcctggaggtggggccttggggtaggaggtccccacaacatgtggaaacgcagtaggcatgggagattgaagtctccacttctgactcacctgctaatgggaaaagtgcagactcttgggctccataatggggtaggggttgagaaggtattttaaaagccaggcttagtggggaaataaaaactaaagcagacccacccagagagctgtcttacaactatctattattttcacatggactggggggagtatgggatgggcagagttgagtgcatcttagaaaatccaggtgagaggctgtggccaagggaacccacgggcccggtgctctgaagccctgggctgctggaaccggcttgacggtgtctttctctgttctcctccccacag

SEQ ID NO: 30654 - DNA, 784 bp, Homo sapiens
gagaagccgtataagtgtgagacgtgcggctcgcgctttgtacaggtacggagccagcctccaagtggcttccaaggcaaacctgcaagaggtggggtgggcccatagggagggttctgttcctcccagaggcaggacttgaagtctcctccctcccaggtggcacatctgcgggcgcacgtgctgatccacaccggggagaagccctacccttgccctacctgcggaacccgcttccgccacctgcagaccctcaagagccacgttcgcatccacaccggagagaagccttaccacgaaccagtgacttcatgaagtttctccggagccacctgcatcctgctgctctgaagtcacttcctgcctgaggtgtggaggcggcagggagaaaccaggaagccactaataatatcaagaggccggggcgtgcatctgtgctggagatcttaatgctggcgacatgcctccatcaccaaggaagatggataagagttgggtcccgtaaagaccacaggggctggaggtggcactgagaagactgagttagaactaacgggccagcccaccctcccccagcaagggtatcttgaatctatccagggtccagtgcatgcatctctcccaccctttcccctgtcctgtgtgtgtgctgggtgcggaggtcactaattctgatattaccttcctctgggccttaaattcctcatctgtgaaaaagtcagttaccatgatctctgcagctacctccaacattgaaagtttgtagttgtcttaaaatgtcttc

SEQ ID NO: 30655 - DNA, 201 bp, Homo sapiens
agatggagcacgtggtccaggcatgccaccgcttcatccaggccagctatgaacctctgggcatctccgcttccgccacctgcagaccctcaagagccacgttcgcatccacaccggagagaagccttaccactgcgacccctgtggcctgcatttccggcacaagagtcaactgcggctgcatctgcgccagaaacacgg

SEQ ID NO: 30656 - DNA, 1254 bp, Homo sapiens
gaaccattatgttgagcccaaaatggaagtaataataaatgcctcctggaggctgtgggtgtgggggattctgtatctggattccgtatcactccaagtggaggctggcaggtttttctgcaagatggtccagaatctaaaatgtcccattaatctggtcacttgggtttggctctgctgtatccatctatagtggtagagacccaccagggctcaagtggagtccatcatcctcccacgggggcctgttcttagcactgagttgatcgctccatgggggagagatcagacattccttatcagagatgatgtgaccttttctgactctgcccagtctctatgaatgttatggcctagggaagaatcatgaaactctttagcttgattagatggtaaacagtgttaacccatcctttactacagaggcatatgggtttgaatgttacctggggttctctctattgagttgagccccttcttcctttagtgggttttggacatcttctggcaagtgtccagatgccagaaccttcttttcctctagaagggatggtgcttggtaaccttaccttttaaaagctgggtctgtgacctggtcttcccatccctgcattcctgtctggaaccagtgaatgcattagaaccttccataggaaaagaaaaggggctgagttccattctgggtttgctgtagtttggttgggattattgttggcattacagatgtaaaagattgactagcccataggccaaaggcctgttctagttgaccaagtttcaagtaggattaagaggttggttgaggggtgcagtttctggtgtaggccaggtaggtagaaagtgaggaacagggttgcctcttggctgggtggagtctctgaaatgttagaagaagcgctgaagccttgattgatagttctgccccttgttgccctggggcttatctgattatgggacgagggtagaaagtaagaagcacttttgaatttgtggggtagaacttcaacaataagtcagttctagtggctgtcgcctggggactagtgagaaagctactcttctccctcttccctctttctccccatggccccactgcagaattaaagaaggaagaagggaaggcggaggagtctataagaaggaatcatgatttctatttagcagattggatgggcaggtggagaatgcctgggggtagaaatgttagatcttgcaacatcagatccttggaataaagaagcctctctgtgctgc

SEQ ID NO: 30657 - DNA, 1911 bp, Homo sapiens
gaaccattatgttgagcccaaaatggaagtaataataaatgcctcctggaggctgtgggtgtgggggattctgtatctggattccgtatcactccaagtggaggctggcaggtttttctgcaagatggtccagaatctaaaatgtcccattaatctggtcacttgggtttggctctgctgtatccatctatagtggtagagacccaccagggctcaagtggagtccatcatcctcccacgggggcctgttcttagcactgagttgatcgctccatgggggagagatcagacattccttatcagagatgatgtgaccttttctgactctgcccagtctctatgaatgttatggcctagggaagaatcatgaaactctttagcttgattagatggtaaacagtgttaacccatcctttactacagaggcatatgggtttgaatgttacctggggttctctctattgagttgagccccttcttcctttagtgggttttggacatcttctggcaagtgtccagatgccagaaccttcttttcctctagaagggatggtgcttggtaaccttaccttttaaaagctgggtctgtgacctggtcttcccatccctgcattcctgtctggaaccagtgaatgcattagaaccttccataggaaaagaaaaggggctgagttccattctgggtttgctgtagtttggttgggattattgttggcattacagatgtaaaagattgactagcccataggccaaaggcctgttctagttgaccaagtttcaagtaggattaagaggttggttgaggggtgcagtttctggtgtaggccaggtaggtagaaagtgaggaacagggttgcctcttggctgggtggagtctctgaaatgttagaagaagcgctgaagccttgattgatagttctgccccttgttgccctggggcttatctgattatgggacgagggtagaaagtaagaagcacttttgaatttgtggggtagaacttcaacaataagtcagttctagtggctgtcgcctggggactagtgagaaagctactcttctccctcttccctctttctccccatggccccactgcagaattaaagaaggaagaagggaaggcggaggagtctataagaaggaatcatgatttctatttagcagattggatgggcaggtggagaatgcctgggggtagaaatgttagatcttgcaacatcagatccttggaataaagaagcctctctgtgctgcctgctgtgtcctgggttcttgccttgggggactcggggagcgaggaagagagctcttcctcctggataacatcttggattctgtaccattccactgtcccttcccaccagacattttaaatggtcctcgttgtccccttccctgcccttgccttcctgctcattgtgtaggaaccagtgacttcatgaagtttctccggagccacctgcatcctgctgctctgaagtcacttcctgcctgaggtgtggaggcggcagggagaaaccaggaagccactaataatatcaagaggccggggcgtgcatctgtgctggagatcttaatgctggcgacatgcctccatcaccaaggaagatggataagagttgggtcccgtaaagaccacaggggctggaggtggcactgagaagactgagttagaactaacgggccagcccaccctcccccagcaagggtatcttgaatctatccagggtccagtgcatgcatctctcccaccctttcccctgtcctgtgtgtgtgctgggtgcggaggtcactaattctgatattaccttcctctgggccttaaattcctcatctgtgaaaaagtcagttaccatgatctctgcagctacctccaacattgaaagtttgtagttgtcttaaaatgtcttc

SEQ ID NO: 30658 - DNA, 1194 bp, Homo sapiens
gaaccattatgttgagcccaaaatggaagtaataataaatgcctcctggaggctgtgggtgtgggggattctgtatctggattccgtatcactccaagtggaggctgtgggtgtgggggattctgtatctggattcccgtatccactccaagtggagtctctgaaatgttagaagaagcgctgaagccttgattgatagttctgccccttgttgccctggggcttatctgattatgggacgagggtagaaagtaagaagcacttttgaatttgtggggtagaacttcaacaataagtcagttctagtggctgtcgcctggggactagtgagaaagctactcttctccctcttccctctttctccccatggccccactgcagaattaaagaaggaagaagggaaggcggaggagtctataagaaggaatcatgatttctatttagcagattggatgggcaggtggagaatgcctgggggtagaaatgttagatcttgcaacatcagatccttggaataaagaagcctctctgtgctgcctgctgtgtcctgggttcttgccttgggggactcggggagcgaggaagagagctcttcctcctggataacatcttggattctgtaccattccactgtcccttcccaccagacattttaaatggtcctcgttgtccccttccctgcccttgccttcctgctcattgtgtaggaaccagtgacttcatgaagtttctccggagccacctgcatcctgctgctctgaagtcacttcctgcctgaggtgtggaggcggcagggagaaaccaggaagccactaataatatcaagaggccggggcgtgcatctgtgctggagatcttaatgctggcgacatgcctccatcaccaaggaagatggataagagttgggtcccgtaaagaccacaggggctggaggtggcactgagaagactgagttagaactaacgggccagcccaccctcccccagcaagggtatcttgaatctatccagggtccagtgcatgcatctctcccaccctttcccctgtcctgtgtgtgtgctgggtgcggaggtcactaattctgatattaccttcctctgggccttaaattcctcatctgtgaaaaagtcagttaccatgatctctgcagctacctccaacattgaaagtttgtagttgtcttaaaatgtcttc

SEQ ID NO: 30659 - DNA, 444 bp, Homo sapiens
cactgaaagtaaggaggagcagatagagaagaatttggaagatccactgacttccctgctccaattcaagtaatcttgtctttcagatgattcttacataagaaatttaaaaattacctccatcttattagggcattttttccactataaaatgttaagatccaacttactttttaaagatttatagtattttattttttctaccttactttaaaaaaatgtatctatttcgctgggcgcagtggcccacgtctgtaatcccagcactttgggaggccgaggcgggtagatcttgaggtctggagatcaagaccatcctggctaacacagtgaaaccctgtctctactaaaattacaaaaaatatttttttgtggtgacagaaaaaatacaggtgtggtaacacgcgcctgtagtcccagctactcaggagcctgagggaggag

SEQ ID NO: 30660 - DNA, 564 bp, Homo sapiens
gatgtaacaagataatttcttttcctaaaattatagagcataatgtataattttatatctattctcaatagctgaagttaggtgctcaaaatgttttcagaattattaaataaagatgtatgttacgagattactatgcgttgacaatatagtgactgcaataaaattatactactaagctattaaccttgaggaatctgtcatgaacttgcaccccacaaaggagaggaatctgagcactcacccatcatagatgactttaagacttcttaagggccgggcgccgtggctcatgcctgtaatcccagcactttgggaggccgaggcgggcggatcacagggtcaggagatcaagaccatcctggctaacacggtgaaaccccttctctaccaaaaatacaaaaaaattagccgggcgtggtggcgggcgcctgtagtcccagctactcaggaggctgaggcaggagaacggtgtgaacccggaaggcggagcttgcagtgagctgagatcacaccactgcactccagcctgggcgacagagcgagactccatctcaacaacaa

SEQ ID NO: 30661 - DNA, 294 bp, Homo sapiens
caaatgtggcttgttatacagtctcttctctatttacttcctgataaggtccttgatgcaatgcccagtaggcagcagacactgaataaatatttgttaaaggggatcaagaattgtgacttctagaatttctgcaggcaatcaaagattattaataagagaaaggagatgaaccaggggaaccagaagaccatttgaaggaagataatggaaaattttcttttaggtgaaatagagatgagataagcaaagcgaggctaccattttgaaattctctctgtgtgtaaagaattc

SEQ ID NO: 30662 - DNA, 924 bp, Homo sapiens
atgctgaatacaacctcagtcaccgaatttctcctcttgggagtgacagacattcaagaactgcagccttttctcttcgtggttttcctcaccatctacttcatcagtgtgactgggaatggagccgttctgatgattgtcatctccgatcctagactccattcccttatgtatttcttcctgggaaacctgtcctacctggatatctgttactctacggtgacactgccaaaaatgctgcagaactttctctctacacacaaagcaatttctttcttgggatgcataagccagcttcatttcttccacttcctgggcagcacggagtccatgttgttcgccgtgatggcatttgacctctctgtggctatctgcaagccacttcgctacactgtcatcatgaaccctcagctctgtacccagatggccatcacaatctgggtcattggttttttccatgccctgctgcactccgtaatgacttctcgcttgaacttctgtggttccaaccgtatccatcattttctctgtgatattaagccattgctaaagctggcctgtgggaacactgagcttaatcagtggctactcagtactgtcacggggacaattgccatgggccccttctttctgacacttctctcctatttctacattatcacttatctcttcttcaagacccgttcttgtagcatgctctgtaaagcactgtccacttgtgcctcccacttcatggtagttattcttttctatgcacctgttcttttcacctatatccatcctgcgttagagagcttcatggaccaggaccggattgttgccatcatgtacactgtggtcactcctgtactaaacccactgatctatactttgaggaacaaggaagtgaagggggccttgggtagagtgatcagaaggctttga

SEQ ID NO: 30663 - DNA, 226 bp, Homo sapiens
caagacaataaaacaagcaagcaacaacaacaacaacaaaaaactctcctagaaatattagatagaggggaacttcctcaacttgataaagagcatgtaacaacttgataaagaacagctaatttacttaacggtaaaagactaagtcaaggatgtcttcttataccactcctattcaacattgtgctgaaagttctagccagaacaattagggaagaaaaggaaa

SEQ ID NO: 30664 - DNA, 430 bp, Homo sapiens
tgaagtgagctccaccaattgatagactaaatctcattcctaaatgtgaccacagagccaaggaccaccagatagttgaagaaagcttctaacaggaaatatagagaccaaaacaaacaggcaggtaaaaagaacttgaaagaaacagagatattaaggaacagaagaaaactaacaaaaacaacaacaacaaagcaatattgtacccttataagagagagctcatccatgaaacaggaatatgagtctataaaaaagaataaagagcaatataatgctctgaaaaattaaatacttctatccaacatattttaaaaaaccatttgaaactttagttctggattgttacgattttattaatttatgcctcttattattaggacttttttgttcacagttgtattcccaaaatacatagtttcaaaataca

SEQ ID NO: 30665 - DNA, 589 bp, Homo sapiens
ataagttcaacagcaaggcctcctatacttgatgtcttactgcagcgtcctttgtgctgggagctaaaaatggcaggacaaaggaaaggtgcgcacggtagaagggccttgagtatttgggaagtactcatggagtcacctcctccattgcctttagaacttatttctgactcctggtggtcagtgctccctaagtctttattttaaagtggaggctcctcagcgagcctcagggaatatgttactgctcacctggctctgaaagactgagtgtcactgaggctttagaaatggttctcgaagtgtggtcctcagagtacctttgttggaattgttgcatgtgcatatgtgtctgttggtggggggtggtacataccaaaaatactggattctgaacatcacatcagagtctctgaggatgaggtccaggaatttcactgagctccccagatgatgtttatgggcagtagcatttacgaaattctgttttcatgtcctgtttacaaagaagagggaaaaaatgcttgaacatcattaagaaggtaatcctaatatttttaaattaattttatttcatttaatcatatac

SEQ ID NO: 30666 - DNA, 745 bp, Homo sapiens
ccactgcctctggctttattttgcagaatttgaatgttaaacttttaaccttttgtttcagtcaatatctgctatcttcaagaaggactgaaacaataaattaaaagcttaatactcaggagctaggcatgcttgtagtcccagctactcatgaggcttaaatggaggatcacttgaggcctagccttggaggctgcagtgcactgtgattgtgcctgtaaatagctattgcactccagccttggcaacataatgagacactgtcactttaaaaaatggcaaaactaaataaacgtaaaagaaatacaacaagcttttcaatgatttgtaaatgtttgtagcattgttacttctacaagtatcaaagcttaaaatttcactaagacttttggaattcttgtgtttttataaagtgcccttttctcttgtaaagtagctctttgcaaggcttttatctgcattgatcacctcagattattttccctagatgtgataaagaggaggatccatgttaattcatatgtaacaaattagaaggaattggaccctaatagtagtaggtgatgcaatacattttattatcccacatgttagcctggatgcaggtatcatatttcatgtcctgctatttaaaaagaacttccgtaaaccttaggaatcctacctcctgaaaaagtatcatttatggaatgcagagcttagagattggagtattgattgcagttttattttcaaaataaatgct

SEQ ID NO: 30667 - DNA, 164 bp, Homo sapiens
tgatcccttgggtcctatatctgtcacccactttaggtacttatcaactgattagtcttgtttctgtacctatacccactcctcacttatcttcattatggtcatatcttctttaaaaactggaaatgtaaatgtgtttctcttctatgaaaggataagaagtt

SEQ ID NO: 30668 - DNA, 570 bp, Homo sapiens
tggtggtacctaagtgctgcagttcctgtgaggaacctgagatggtcacggccgtgtggcggatgtgcgtatgagcctgggaagaccccaggcccggttgactacgtggaggcctttcagtggacaagtgtgactcagggcccagaaacagtgacgttaaaaatatgaaaatgtgttacaatagcaagttaatctaaaccgttttatcagcagcacccacaacagtgcctggtgtacagcaggcactaaataaatgctggtagcgaacgaaagagtgagtcatgcacaccagatctcacccagtggtggtggcgtgctggagggtgatgctgagatggattcggaggctccatccaagggcaataggcaggaatcctgtgctccctgagggctgcctgcgagaaaagggcagggcatcatggtggcacatgtagcattatagctgccctgatctgcgtcctttgctaaaggactccttcagttaatggggacagactgtgtgtaagagatcctgtggaaagttacgttttccatccacccctccgaccatccaatgaatatttattgagt

SEQ ID NO: 30669 - DNA, 169 bp, Homo sapiens
aaatacatggaaattaaataacctgctcctgaatgaacgttgggttaacaatgaaataaagttggaaattaaaaaattctttgaactgaatggtaagaatgatacaacctctcaaacctgtgtaatatagaagtagaagaaaagaagtaacaaaaatcagggcagaact

SEQ ID NO: 30670 - DNA, 471 bp, Homo sapiens
tttttgctcagttctacctaatgattgtaaaatctgtcctctcagtagtgacaattagtatcctcatacatattagtcatatatatccccgctcaaaactttcagacatgtgttgtaggctgaaggagaaaagaccatgattaaggtgttagcctgtcaagttataaaaaaccaaatggcatagtatagtaaagcagctgtgatttttttgtctgaggcgccactcagaaatatcctgttttcccgttcattttccctttccatagatgcccttgcagtcaccttccaggatgccccttggctgtctttaggtgtcagaaccttccactttcctactgactgtgaagggcatgtaaatgcctgggcatcattagaaagccagggagagctcatttaacctgatgtgtcagtagaattttgaagcagataatttgaaaatgtgtaataatactcgctaaatcagatcatttg

SEQ ID NO: 30671 - DNA, 401 bp, Homo sapiens
atgctctgtactcctgatagtcagagtcctcgatctggcaactgacaatgagctttaaaacagcccacctctttcctagagagataagacgaggcagaacagaatcattggaagaaacagcttcagagtcagaactcctgtcaagtcctggctcagtcacttgggaattgagtggcctcaggcaatttatgaaacctcagtttcctgatctgtgaaatggagagaataaaactacttgttttggagatgaaaagagatcatgcacaggcactaaggacacaggaagcatttacaagataagagcaattgagcctgcagtgagccgccactgtactccactgtactctgggggacgacaaagtgagaccctgtttcaaaaataaataaataaataataaatg

SEQ ID NO: 30672 - DNA, 1548 bp, Homo sapiens
gacctttcagagccaggagggctttcgggggcgtggggcgcgctgcggagcggagccgcggctcgacggcggtgcgctggcggcgagtgtatgcagacggcgcccggcccgaaccccgagccccgcggggctccccacccgccggcctcccgcccctcccgcgcctccgcctggggaccacgtcggccttttgttggcgaaccgtcctttctttcagcgctttgcgcagcaacggaaatttcattgctcctgggtggaaattaaagggactcgcgttccctctctccctctccctctcccactctccctctctttctctctctcgcccacccttcccccttcttcccccacctttcccgcgaagccggagtcagcatctccaggcgcgggatcccgctccgagcacctcgcagctgtccggctgccgccccttccatgggcgccgcgctcgcctgcagccgccgccgccgcggggcgggcgcgatgccacgatgggcctaatctggctgctactgctcagcctgctggagcccggctggcccgcagcgggccctggggcgcggttgcggcgcgatgcgggcggccgtggcggcgtctacgagcaccttggcggggcgccccggcgccgcaagctctactgcgccacgaagtaccacctccagctgcacccgagcggccgcgtcaacggcagcctggagaacagcgcctacagtattttggagataacggcagtggaggtgggcattgtggccatcaggggtctcttctccgggcggtacctggccatgaacaagaggggacgactctatgcttcggagcactacagcgccgagtgcgagtttgtggagcggatccacgagctgggctataatacgtatgcctcccggctgtaccggacggtgtctagtacgcctggggcccgccggcagcccagcgccgagagactgtggtacgtgtctgtgaacggcaagggccggccccgcaggggcttcaagacccgccgcacacagaagtcctccctgttcctgccccgcgtgctggaccacagggaccacgagatggtgcggcagctacagagtgggctgcccagaccccctggtaagggggtccagccccgacggcggcggcagaagcagagcccggataacctggagccctctcacgttcaggcttcgagactgggctcccagctggaggccagtgcgcactagctgggcctggtggccaccgccagagctcctggcgacatcttggcgtggcagcctcttgactctgactctcctccttgagcccttgcccctgcgtcccgcgtctgggttctcagctatttccagagccagctcaaatcagggtccagtgggaactgaagagggcccaagtcggagctcggagggggctgcctgcaatgcagggcatttgtgggtctgtgtggcaggaagccggcagggaagggcctgagtgccagccctggcagactgaggagcctcccaggagcagcggggcagtgtggggctttgtgtcatcacaacattaaagtattttattcta

SEQ ID NO: 30673 - DNA, 388 bp, Homo sapiens
caagaacacagcaggccagggtatccagctgagtaagtggcagctaggaacagaggtcaggaacacagagggggctttgtgaaaaatatccagcattctgctatttcaataaccctgtcctgagcagtgaggcccacatgcagtacaggaggaagggggaggtttgagagggaaaaatgagctcacccgagctcccaatggcagaggccaagcagccattgccttctccttccttcctgtggggttcttccttggggagggacagaagccaaaggaggcagagctgagggaagggaaagaagccatgagaaacaagactcctgcaacagcaacaatgaaaatacctataaataaactaaataagacctggatagtagctacataaaga

SEQ ID NO: 30674 - DNA, 1397 bp, Homo sapiens
ccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccatatgttgaaatcttaacccccaatgtgatgatattaggatgcggagcccttgggaggtcgtaagcatggagcccacgtgagtgggattagtgcccttatgaagagatcccagccctctttctgccatgcgaacacacagcaagaagatgcctgtctatgaaccagggggcccttaccagaaacaaacctactagcatcttgatctcggactttccagttcccataaccatgagaaataaatgtttttaattcaatgtatggtattttattatagcagctctacctaagacagtacatgtatagtgtctatttgaacattactgataatgttgaacaacttttcatgtttattagttattaggtttcttcaagtgttcttattcatacaaattttaaaatatgtacacaagttctttgttatatattttgcaaatatcttctgtggcttgtcttttcactattttagttctgtcttttgataaacaggagcttttaatttttatgtcaaatctatcaagctttttctttttgatttatgttttttatgtcttatttgagaaatccttctataccccaagatcatgaggatgtttcctgtgttctcttctgaaagctatatagtctttgtcatttaggtttatctttatacgtggtatgaagtgtaaagttctacttttaattttttgcatattttattaggataggatgggctttttctgtagtaataatccctaaatctcaggggcttaatatataaaattgtctcatgcaaaaaaccactgggtctagggcaattgctatctactgccgtctaatctccctctagtggcttccattggtagaccctaacaggaagccagctgataagggaatctgggaaatgtagtttacagagtggcagctacagtagaacagtagagactacaaggatgagcttgcagctgagaatagaaacgtgactggcacactaggtggtttgtttgtaggttttttcttttcctgtttgagacttttttggattcttgaatttgtacaatggtatccttaatcaattgtggaaaattaaatgattttttctttcagcattgtctgtttcttctgtaactgattaaatgtaagttggatcatatcatgata

SEQ ID NO: 30675 - DNA, 477 bp, Homo sapiens
gctttgtatgtgatttgcttttaagatgttggaaatgagaatctgatatattagagaatttgacttacaagatttgcaattttaagtgtaacacctaggaggatttaatgaattaattttgtagtcaatgtttggatgctcaggagaacctgaatttatcagtttaattctcagcaggttgaaatgctttaagagaatttgtgtgctaaatttagaagttttgatttattagtcttacaagaactaagtaagtcctgagaaagattttgtttcttctatttgtaagtcttcctgttagggatttgaagattttaacaaagccagatgtatcaaatttgtgagtatagtttgaaatgcttagaggaatttaattaatcaagtttataaatactgtttacattttgaaagattatttgatttgttaagcttataaaaattgtgactaataaaaatatgtaagattgatttgattaagtt

SEQ ID NO: 30676 - DNA, 1441 bp, Homo sapiens
  misc_feature (1441)..(1441): n is a, c, g, or t
ctttatgctctgggttttgctttatggaaacaaggatgaaaaacatgatacctttaataacaactgtctcttagaagataatgtgccctggaccgaatggcaagagaaattggatcatttgttctgaaatgaagtcagttccagcaactgtggtctttgcattcttgtggccctagtcccatccatttttcacacaacagcaagaaaaatcttttgaaaataaatggaatcatgtcactcccttccttagactctcctaatgactgtgttcactttagcacttagattaaaattcaaatatccacctttgccctgccagctctggctcttccctaactcattcctgccattcctccctttgcttactgtgctccagccacactggtgtttgaactcattggaacaggcaaaattatttcctacctgagaggcattgcatgttttgtttctttagtctgaaatgcccaccctgacctcttgctgcactgtgcttggttagttctttcttatcctttacatcttagcaaaatgttaactcaaagagcactttgcttaccaccatatttaaagtacaagcttccttacatctgttttacagtactctattccttcatagttcttattgtgctgtgttgtttctttcaaagcttttattacacaagttgtaattattttattttattttatttttgagacagagtctcgcttttctgcccaggctataatgtagtggcgcgatctcagctcactgcaacctccacctcccgggttcacgccattctcctgcctcagcctccccagcagctgggactacaggcgcctgccaccacgcctggctaattttttgtatttttagtagagacagggtttcaccatgttagccaggatggtctcgatctcctgaccttgtgatccgcccgcctcggcctcccaaagtgttgggattacaggcttgagccactgcgcctggcagttgtaattattttatttgctaactttttataaatctggggtgacagaagcgaagactctgctctcacaaacattaacttacactcacacattactcaggactttcttcatacggtgacacgaaacgatgtcctatcttgactttttccctataacaagtctaggttgaattcaggtacatgccttggaaattggcaggaatacctgtaaagtgtgccacttaaatcggcactggagctcctagggcaacatccattaactaccccagcattaaaaccttaccaccattaagggctgtgagaatagggaagcaacaaactataaggatcctaaacgcaccggtatatttcaggcttggaacccgatatatacgaatatacaaggacactggcactttgcacctggccccactgcctgcacgtgactatcacaaggacctggaggtagggagtgcttcacaacacgccan

SEQ ID NO: 30677 - DNA, 860 bp, Homo sapiens
tgtgacacacggcctggttctgagaagcggcgggcagggtggccattgccatgtgacacatggcctggttctgagaagcggcaggcagggtggccgttgccatgtcatgtgacacacggcctggttctgagaagcggcaggcagggtggccgttgtcatgcgacacacggcctggttctgagaagtggtgggcagggtggctgttgctcagaaagccacactttggcttttgctgttcaccaaagtgagaccagaccagcctcgtctctgcccttcatgttggttccttcctttcactggatccagaggggctttgagtgtattgggtggcggcagtagtcacccctctgatcttctgtcttgggcatctcagtaggaagtcgggggactgcggggctgagctcagttctggttgacgttgtgactgcgtggccttctcttggccttgtgcctcagtggactgcagtctgcaattcggtctgactctgctgtgaaaccctgttcttaaagctaacttggcgctctactggcaaccccgattgctgttttaaaagcagaggatcagcataaaaaaagagaaggaaatcatgaactaggtgaaaaaacacatttttcttcatattctcaaaatgagagggaagcagaagtctgtggctaagggtggagaccctgcgtctgtgaacagaggccactgcccaccactgcccccaagcaggtggagggaggcacagttctgaatgcctttggcccctcacaaggaaggtggcacacacaccggaccccctctggccttctgttaacctgcaccaagtcctgactgtccgcggagctgccgcgcccaccttgatggctgctgcgtt

SEQ ID NO: 30678 - DNA, 1183 bp, Homo sapiens
ggaagggtggccgccccgccagcagagagctgaaggtgttccgtggtcagtgagggctggcactggctctgcacgaagatctcctcacctccccagcggctcctggccagctccccacggagagcccaggacacttgtccctggacacagtggtgcagccatgcttgggccaaaccatgaggccaccagaaccgcgaaaggctactgtactgagagggatactgcgagagaggcccacaggtttccaagcatccctctcactccgcacactcatctccacgaccggctttaagtgcggccttgaggcctggctccctgtttggacttctctgcacctccaggagctcacttcccgtcacagctggatgcctcctcccgcaggcacctcccgggcatcctcccgccccaggctgcaccttctgtgggactgagccccgcaggcacttccccggcatcctcccgccccaggctgcagcttctgtgggactgaccttaagaccccatcggttcctcctgagagcagcagatctcagccagatgctgccgggagggaggtgctagcgtccacaccagacgggtccagtccagccctgctctccctggtctccaggcagggccctcccagggtggacattgcccatctctgcctggccaggggctgctgacccactggttccagagtctgagcctgtcctgcacaagtaccatggacaggggtcagccgggcactgaagaggcgtggcagaattgggcagggcaagggccccagctggcaagctggagtcagggcaattccaaccaagaaactgcggcaggccgggtgcagtgtctcaagcctataatcccagcactttgggaggcagtgggagaatcgcttgagcccgggagtttgagaccagcattggtaacatagagaccctatcgctacaagaaaaaaaaaaaaaaaaagctgggcatggtggtgcacacctgttgtcccagctattcaggaggctgacgtgggaggattgcttgtgcccaggggttgcaggctgcagtgagctgtgatcataccactgcactccagcctgggcgacagagaacctctctaaaaaaaaaggaaaatgaaaaataaatgggggcagaagctgagccaagcagaggcgggcagctcctcctccagggcccacctggcctgctgggg

SEQ ID NO: 30679 - DNA, 1839 bp, Homo sapiens
aaatagactgtcaaacaatgaattggcaactacggttaggtagagcggtttatcggccgaggcggcgtctgcagccggagcctgcctcgcctggctcctgcgcccgccgtccagggcccctgtccaagctcgcggacgccggcggcgttttccagctcgagtgctcagcctagggcaggctctgcgtgcgccccctcgagtgccggcctgggccctgccaggcagaggcgctcttgcgtcaggacggcgccgccggggccccgcgattccaactcgggggtcccggagcggcgcggggcggggacggcctggcagctcccagcagcgaggggcgatccccgcccgcgcagcagaccccgagctgcccaggcccttcctgcgccacgtgtacccagagctccgcccgggggagacttcgctgcttgttggagatgcccagcggtagggggcgaggactcgggaggaagataaacgggggatcccgtgtctggactttctcctccaccctcttcccttcgcagctgtgaatcctgggaggggaagggtggccgccccgccagcagagagctgaaggtgttccgtggtcagtgagggctggcactggctctgcacgaagatctcctcacctccccagcggctcctggccagctccccacggagagcccaggacacttgtccctggacacagtggtgcagccatgcttgggccaaaccatgaggccaccagaaccgcgaaaggctactgtactgagagggatactgcgagagaggcccacaggtttccaagcatccctctcactccgcacactcatctccacgaccggctttaagtgcggccttgaggcctggctccctgtttggacttctctgcacctccaggagctcacttcccgtcacagctggatgcctcctcccgcaggcacctcccgggcatcctcccgccccaggctgcaccttctgtgggactggcccccgcaggcacctcccgggcaccctcccgccccaggctgcagcttctgtgggactgagccccgcaggcacctccccggcatcctcccgccccaggctgcaccttctgtgggactgagccccgcaggcacttccccggcatcctcccgccccaggctgcagcttctgtgggactgaccttaagaccccatcggttcctcctgagagcagcagatctcagccagatgctgccgggagggaggtgctagcgtccacaccagacgggtccagtccagccctgctctccctggtctccaggcagggccctcccagggtggacattgcccatctctgcctggccaggggctgctgacccactggttccagagtctgagcctgtcctgcacaagtaccatggacaggggtcagccgggcactgaagaggcgtggcagaattgggcagggcaagggccccagctggcaagctggagtcagggcaattccaaccaagaaactgcggcaggccgggtgcagtgtctcaagcctataatcccagcactttgggaggcagtgggagaatcgcttgagcccgggagtttgagaccagcattggtaacatagagaccctatcgctacaagaaaaaaaaaaaaaaaaagctgggcatggtggtgcacacctgttgtcccagctattcaggaggctgacgtgggaggattgcttgtgcccaggggttgcaggctgcagtgagctgtgatcataccactgcactccagcctgggcgacagagaacctctctaaaaaaaaaggaaaatgaaaaataaatgggggcagaagctgagccaagcagaggcgggcagctcctcctccagggcccacctggcctgctgggg

SEQ ID NO: 30680 - DNA, 389 bp, Homo sapiens
ccctggccacccccttacctgataatgtcgtcgttgtgtcccaggaagaatttttggctgtgctcgcgggtgttgtaaaccaccccgaccccagccacaaagtagaccacctccttgcctgccgtgtagtacaggttgttgcggcactggtgaccccggtacccgtacacccactccagccggagctggcagcggggcgccgtccgatccgccatgataagccgacccgcgcgccccccgccccccgcgcgccggggccgtcctcgccgaggctggggctgcggcggacctgcaggggctcagcgcgcggcgcagggcgctgatttccgcggcgacacacaggcacagcccagcgggccggccgccaccatcatccgctgcagccgccg

SEQ ID NO: 30681 - DNA, 135 bp, Homo sapiens
acacgcttccccagatattgtgggactcattcctccactatctgcaactctttgttcaaatgtccccttctcagtgagttctcctctgactgccctttggaaaatggaaacctacctcaacccagtacttccgat

SEQ ID NO: 30682 - DNA, 457 bp, Homo sapiens
ctgtgataactggctggtgataactggctcgtgatgaccggcccatgatgactggcccgtgataactggctcgtgatgaccacccgtgatgaccgcccgtgatgaccggcccgtgataactggctggtgataactggctcgtgatgaccacccgtgatgaccgcccgtgatgaccggccgtgataactggctggtgataactggctcgtgatgaccagcccgtgaaggacaaggaagagggatggctgctcagatgccggggcctgcagtgctgatgagggtgtgcctgggccacatcgccatggaggacgggaggggcctgttcgtttctagagggacacgccggccacccggatgcagataccacgtcctcacggatgcgcacacgttgcttagacaccatcacgtgagccttttgagctttgaaggttgagaacatattcctaagaacacacat

SEQ ID NO: 30683 - DNA, 486 bp, Homo sapiens
ctttttagtattgtcctcaagggtgctggcaagctgatttgccaaattaactagatcagaggtgggcacagtttcccattctgttcgggcccttttgaccagctgggagagttcttgagaaaggctgttcactaacatggaataaaaggctacttgagtagattcaacattttctttaaatacagcctggagcctactgtaatagttgtacattaggttctttcttgggcacaggcctggaggtttttccagtctaaggctttaggaagagcctcgagaacagacttgtggagtgtttttttttccttctatgcctttgactctatccatagtctttaggggtgtttttgtctaaatccccctcaggatcatggcagtgagccttgaccatccagtgttgtgcctgaccttcactgacaagaatgtgaaccacctactgtgggtcagaaaaacctggctgataaccctaagttactatgtccaatt

SEQ ID NO: 30684 - DNA, 402 bp, Homo sapiens
tccagtttaaatttctttgaagaatagtgagaactgagagatcattttgatctcctttcaatcttctatggttttatagtttttctgactttttataattaccttacctacctctaattaaatagcagtgaatttaaaaacacatctgtgctgggcctttcacattcagtttaggtgttacagaaaaactaactctttatacttttatttattactttgaggcatacgtaattaaattgtgcaattataataacaggttgtggcaaatatgataggattgggcttaacatctgttgcaccttccttttaatatggccttcctgtattgcagaggctggaaaactaaaaactagttcaggatatgggtttggttctgctaatgataaccacttgtacgatacc

SEQ ID NO: 30685 - DNA, 326 bp, Homo sapiens
cttccagtgggattaaagctaattgcgtccatcgcttgtcagcagtgtgggacagaaattttattgacctatttccagttataaactcacatgatttaaagggaggaagcttttattaaattaataactaacgaacagctgcagtagttcagtgcttctgtatgattaggattttctctttttttctctcattttagccactcacgatgtcagctcgtgcaccttctactaagttagattccttaaccacaatacaagtctttggcccaaacctgggatataaaagctacttgctatgatttcttttttagtctcataaaaaaaaa

SEQ ID NO: 30686 - DNA, 450 bp, Homo sapiens
cttttagtccatcaacaaacacaaagtgggtgggtgtccaccgcccagccccctgaggaagagcttggctctgcctgttgaccacttggtcacatactcaccttccttgctgagacctgcggcctccccattcagagctacttcttccaggtggagctagtgcccaggacattctgatactgcacactagcctctttcatagcaatctcctgcctgctgtggtgaaactctcagcccctcccctcttctgtcacccccacaccggctctcctgcatgaaggaaactgagcacagagtggtgcctcctcaatgggagtggagactggtgtgtggaccactgtgcaagccagtttaatgctggccccacagggtttggcagtctctttcttatagtgggaccagcagaaactccctaattttaacaatcaggaaattcttttgaaaaatact

SEQ ID NO: 30687 - DNA, 289 bp, Homo sapiens
aaggaagtgggttcagtctgcagcccacatcctgggctgtcatcaagaattaacatggcaaacggcgactccataaagtaaactgtagctacttaactaaatgatttcgtgtggctgagatcctactgtttgctgggtttcctggaaaagtcctctagatgaactgcaggaatctcctggcactctggttacagctggagaaactgatttctgtgctgtccaggtgctcccagacccccaaggcatctccaggacacagtcaccaaacccccatcctggtattactggc

SEQ ID NO: 30688 - DNA, 454 bp, Homo sapiens
tttttattatcttttttttttaattttaaaatcttttgtagaaacagagtgcccctgttttgcccaggcttgtcccaaacccctcgcctcaagcgatcctcccatcttggcctcccaaagtgttgggattatagacatgagccaccgtacctggcctttaattttcttgtcactcagattctgacagataaagtatcatttcagtagtggttttagatgtgttctgtctgcccatctgataaccgaaaatttatcactttcatgaataagtgttttcagaccaatattcaatagttggataaattttacattaatatatttaaatttattctgtccttatcaggtggtttgatttaataattttaaataattaaaacagaaattaagtctagtttaaaaaaaattgtctccagtaagcctaccaagaaatttggtatttcattaggtcaaaaaa

SEQ ID NO: 30689 - DNA, 364 bp, Homo sapiens
ttgagaccgggctacaaggtgaaaccccatctctactaacaatacaataattagccaggtgtggtggtgcatgcctgtaatcccagctacttgggaggctgaggaacaagaattgcttgaacctgggaggcagatattaccccacactcaacaaataaatatgaaagaactttacttacaggataacatcatgataaaatttgcattttagaataactctacaattaacaataaaaagaagtacctataacattaccccacaaaagggataaggtgtggtgaacttggaaatttcatacaatttagaaatatgtattgagctgtaaaaatgttcatattcattgacataaaactttcacatctg

SEQ ID NO: 30690 - DNA, 426 bp, Homo sapiens
ctggctctcaaagatggacaaatggctttacgacgcttaaggggatgctctgtggagtctgcttgggtgcaaatcaccaccatgacacactacccaatgagcaaacaaaagcaaactggttaaggatcctgacaaagacttcgcagccagaagaggcgatgccgtgggtcaaatctaggaccaccagatttcaaaccttatacttctaatcactatatgacactgaacatgattttaagaaactttcttacaaaaatgtatgaattggacaagagagtaacaaaaacagagtaattcactgatctctcattttgtagatgtaagttttgtataatgagtttccatacatcaggagacacttggaaacataaataagtcaaagttacagacaataaagttacagagaattgtattattgtcctctga

SEQ ID NO: 30691 - DNA, 227 bp, Homo sapiens
gcttaaggggatgctctgtggagtctgcttgggtgcaaatcaccaccatgacacactacccagtaagttgcttaccctgctttaagtctccgttttcccatctcatcagtgggtatgttaacagtataggaatatttatgaagattaaattaattaatacagagaaaagcacttagcacagttcctggcacataatataaattagcaatggatgataatgggttcaa

SEQ ID NO: 30692 - DNA, 519 bp, Homo sapiens
taaattcgcggcctgcgtcgacgggatggggactctgtatgttgcctaggctgctctcgaactcctgggctcaagtgatcttcctgccttagcctcccaaagtgctgggattacaggagtgagccattgtgccaggccctgctgggatattccaaggtggggtctctgccccaagtgtcaagaacaatgaactgtaggttgaccaacatgagacctaatttatggaatcttcggcctatattttttcaatgttttgttactcacggtggagcctgtctccagaaaggctggctttcaatgtagtcccagccaccctggctccagagagggctcagcttgcacccaaatagcatcattgtttaacaggcctactttaagattatttttcaagttcccaatacccaactaactcgaaggaagaaatggaaatctattttcttttcttaccatcatttgatcatttgatcatttgctgaattaacaaatacgtacatacgcagacatcagaaaagaagggct

SEQ ID NO: 30693 - DNA, 421 bp, Homo sapiens
tttttttgtagacacaaggtctcactacgttgtccaggctgctctagaactcttgggctcaagagatccacctgcctcagcctcacgaagtgctgggataagaggcgtgagccactgtgccctgcctagttttgcttttaaaatgacttagaaagagggcgatggtgggactcgagaagaggacttatcaatcagcctcctcctgggaatccagagaactttgggctcccaggggagatgttatcagagatgaggctggaggtacgcatagtcttcatgacacatggtcttgatgacttcatgtcaatcaagttcaatactgactgccatgcacatggcagttgcttcatatttgcttcacaaagcaaaggtaggctgggacagacagcttttaagctataagctctttaactaggtagac

SEQ ID NO: 30694 - DNA, 401 bp, Homo sapiens
actatgagtctgttacaataggaattaaaatcatgctcttgggttaacagaccttaatcgtgggtcagttttgtatgttggctacttaagtgaacccataaactataaaaaggagatactttttaaatatctaaataaatatataggaggtttatatttctgagactcgtatttgagaaaagggaaaagtataggaatttggtactgtgtaagtagaagaagaaaaagaatatcagattttaaaatgaaaaagaagataatacattgaaatgaggaataattatgagggaataccaaaaaattactctaactgctcaaatttttatgtctaatgaaagaacaatagcatacttaaaaaatttagagtcagcagaaatgaagccaagaacaagaattcttaa

SEQ ID NO: 30695 - DNA, 899 bp, Homo sapiens
tttagctcttgtgaataatgctgctgtgaacatgggtatatctgagttcctgctttcaattccttggacatatacctaggagtgaaattgctaggtcatacggtattgctatatttaactttatgaggaactgccaaactgtttcccacagcagctgcaccattttgcattcctaccggcatgtatgagggttccagtttctccacatcctccctggcacttgttatcatgtctctataattatagctaccctagtggatgtgaagcagtatttcattgtagttctaatttgcatatttttgatggctaatgcatatttctttcctgataatttgtttttggtaagaaataagccgctttttcctacgttcttccacactcctgtatgaaacaagtaggggagagccaacttgctagacattgactctaaatgtgcccgaggttgtcatcccagcatgtagattgtctgcccctatttctcctccctctgcatgactccctggatcacctgccaacaggggaggcaaacacctcagatatcactaatgttttcccaagcctaataccgtacctaggaaagtgagaaaatttaaatgaaaggtaaaatacagtttaaggcagtagtgaaatgaatttttctacgctctctttagataccatgagaatcagtttatgcctatgctagccataaagttcttaggatatgagagcctggcattacatgctacagcaggagaggtcagagcagccggtgaggttagggcttgggcgtgggtctccatcttctcccacagcttattgaggtctcctttttataaaacataccatagttaacttcatgattagagcagaatgaaaaaaaacattcatctagtgcatggttcaggaggattaaccaa

SEQ ID NO: 30696 - DNA, 880 bp, Homo sapiens
gggcagctgctgctgcggtcgatctagaggattccccaattccattccacgtatgactaggagtgaaattgctaggtcatacggtattgctatatttaactttatgaggaactgccaaactgtttcccacagcagctgcaccattttgcattcctaccggcatgtatgagggttccagtttctccacatcctccctggcacttgttatcatgtctctataattatagctaccctagtggatgtgaagcagtatttcattgtagttctaatttgcatatttttgatggctaatgcatatttctttcctgataatttgtttttggtaagaaataagccgctttttcctacgttcttccacactcctgtatgaaacaagtaggggagagccaacttgctagacattgactctaaatgtgcccgaggttgtcatcccagcatgtagattgtctgcccctatttctcctccctctgcatgactccctggatcacctgccaacaggggaggcaaacacctcagatatcactaatgttttcccaagcctaataccgtacctaggaaagtgagaaaatttaaatgaaaggtaaaatacagtttaaggcagtagtgaaatgaatttttctacgctctctttagataccatgagaatcagtttatgcctatgctagccataaagttcttaggatatgagagcctggcattacatgctacagcaggagaggtcagagcagccggtgaggttagggcttgggcgtgggtctccatcttctcccacagcttattgaggtctcctttttataaaacataccatagttaacttcatgattagagcagaatgaaaaaaaacattcatctagtgcatggttcaggaggattaaccaa

SEQ ID NO: 30697 - DNA, 252 bp, Homo sapiens
gaactagtagacaaactaataaagatatagatgacttgagcaacattattagccaactcaagtccagtatgttctctgactgtaatggaattaaactagtaatctagtttaaactagaaatcaataacagaaaaatgtccaaatacttggaaattaagcagcatatttctaaataatccacaggcaaaacagcaagtttcaagtaaaattagaaaatattttgaactgatcaaaaatgaaaatacagcatat

SEQ ID NO: 30698 - DNA, 280 bp, Homo sapiens
actctgggctcacacaatggtgtgagttttgcctctaggagcctgccagattcttgcaatgaagagttattaaatgctaaagctagtccacactttatctctagtaattaagccaatacccttcaagcatccctactccatgcaggcaatttctgtttctgataagctttgattctctgtagcagcctatcattccagcttttggggtgataacttcaattctataaaggatcggaaaaaagctgttgattctgagttcttcagctttttgttgttgttg

SEQ ID NO: 30699 - DNA, 415 bp, Homo sapiens
gacatgcgcccaaggtggtcaggctacagcttggttttatacattttagggagacataagacatcaatccatacatgtaagaggtacattggttcagtccagaaagatgggacagctggaaacagggactggggagtgtgtggggtgacttccaggtcttaggtggattcaaagactggcaattggttattatctaaagacctgaaatcaatgtctaaattacaataaaggtttgtggacaccaaggttttatcatgcagataaagcctctagatagcaggcttcagagagaatagatggtaagtgtttcttaccagatttaaagagtctcttctggctgggcgcaatggctcacacctgtaatcccgacactttgagaggccaaggcgggaagatcacttgagctcaggagtta

SEQ ID NO: 30700 - DNA, 618 bp, Homo sapiens
cagagtgagaccctgtgtctaaaataatacacttgaaaataaaaatatgatcagagcaattggaattgtacaacagtagtcaattgcattaagataagtgtaaagttcaaactgtagtagtaagtgcagtattagtgaggaaggggtttctttccaagaattatttcaaacaaatacatagaattttgtgggaattcagacgtaagggatgaacgactgaagcgtcagagtcttaagagtttgagcatggttgaatagagtgacctgtgaaagaccaaggctgtggatgtcagttttcatggcaatgttttgaggagtgtagataaaagtatgagaggggatgagctggaagcagccagtaggcttagatgccttaaatagtatacatttaatgtgctaaagggcgttgatgaaggaacagggagcatgctatttagagaagtgagcatggatatcaccttttaaaccattagttagcagtggctcaggtattttctcgatttagagactatagcataccatgtcacactaggaaagcgtatatgaaaatccagacttataaaaattaaagagtagttgcatttaaaaggattcttcattttcagcaggattagtcat

SEQ ID NO: 30701 - DNA, 702 bp, Homo sapiens
catgttccattgaccagactttctaggggagtgaggcttaggaagtgaatctaaggcaagtgtttgatgggaaaggccacggttgtatttctgatttcagggctgacacattgagtatctctccttctcttttttcttagctaaccaagttctgatatgtgtagtattgaagctgtataaatacagtggggatcctgaaattatcatggcaaagggctcagatttaaaattgacagtaacacagaatgaaaacatgggaaatgactaggtattggcctcacatcacacagtttcagggccagggtgcacattggatcctttttgtgcagcaaaatctctgtctttgtagatgagaaatcctggagccattgcaagtttgtaatttatctaaggttacacaactaggttttgtcaaaattgagactagaactagattcagttgactttttttcctaccttccttgcaacacagcagaaagtaacatcaactagtgtaaataactggatgtcttctgtcaaagttttaaccattggtattattattatcattgtgatcgttattttataattagaacagagatagggtagagtagaagaggtaacttgtagaagaaggcataggctaaggaggccattggacttcagcaatgaccaccgtatagcattattgaagacctataggcagctagggttaatgggccc

SEQ ID NO: 30702 - DNA, 229 bp, Homo sapiens
ggctaattttagatcatggctctgccacagaaagtagaactgtagggtttcttttaaaaattaattttaaagtagaccaacttactgtagctctaattaggggacgtttaaggtcatcttcttacaaatgaactggttttcagaagtaattgtttctcagttcttgctgggaaggaggttcccagggcctttgggctaacaggttgcttttcattgacttcaaacatgc

SEQ ID NO: 30703 - DNA, 356 bp, Homo sapiens
tcttttcttcaattctgtggtatgctgcaggtgaagaaactgaggcatagatcacgtagcttgtaagtgatggaacagtggcctaaatccaacatgtgcaactttagaacccatgtatttttcctctgtcccatgccctgtctgatgtaagcaggcttctaagttgcaaataccaggtggtgtggtgtgctttgaagctatttattcaacatgtgtttatcaagaagtgtctgtccaggcgcagtagctcatacctgtaatcctagcactttgggaggccaagatgagaggatcccttgagcccaggagtttgagactagcctgggcaacatacctggacaacatagtgagacccc

SEQ ID NO: 30704 - DNA, 1051 bp, Homo sapiens
gagcccgataccggtttcagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgtta

SEQ ID NO: 30705 - DNA, 358 bp, Homo sapiens
agcataaactattacagcataaactattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgtta

SEQ ID NO: 30706 - DNA, 500 bp, Homo sapiens
gcgtcgacattaatttttttatttagggagaaaagcccaatattgtggttattcactatttatgctttaatagtaatcataattgtaattatggtaaactgagtcagaggaattgcaaactttactattttattttatttttttgagatggagtctcgctgtatcgcccaggctggagtgcagtggcgcgatctcagttcattgcaacgtgggttcatgcatttctcctgcctcagcctcccaaggagctggcccttgcataaggcggccacacaaatttttgaagcattctatattttgcgcagtcactggaaggtcatttgactgtttgctgagtagctttaaggaaatggtgtgaatcaaagcagaatggctgccacaaaaacattgaaattgtgatttgcgcaataaaaatagtcatgtaaggtggtctgtgagatgacaccagagccaaataacgtgtggggtgttgtgtacaaaatatattgttagtatgtatg

SEQ ID NO: 30707 - DNA, 357 bp, Homo sapiens
tccccagactggagcaaaacaatattaaaacagcctgggttacactttattgaagaggccagcttaggacgactttaagaactaggtgaccacagtcttaagacaggcaggggcaaggctgtaagattttactctcagccagttcacactcctaactgtgagatcaggcctctacagaccttatgggcctatcaaacccaaagaaaatttcctggaggtgcctactcagaggggctccctcctggtcactccttatagccttgctcggtccagggcagggtgggttcggtctctcggtgagaacaagaggaacacatttagctctgcattatgtatttaggttgagagaaacaattt

SEQ ID NO: 30708 - DNA, 464 bp, Homo sapiens
gaattacctcctcattcttcctgttgaaattactctcaaatcttttctgacagagttgcaaacacactgacagctcccgaatgatctgatacaggatccttaataggcatggaagtgttcgccagacaaaaatatttgagaacatgacaataatgacactgctaatggcttgtagtttcccgtgatactaatgagacaggctagtttattagtgttttgttctcttttttctatctcctccccatgcccattctgagcagaaagctgtactcttcacatgtccttgcttcaagaaactggttgaagaccacccttcgtccagccttgtgtgagtctgagcttgttgaagagactttgccacaagtttagtggtgggagagggggaaaaggagtgcttttgaggtctgggaaggagaagaagatattttagaaccgactctcacacctcgtgcctcccagcaggg

SEQ ID NO: 30709 - DNA, 323 bp, Homo sapiens
taatagatattctttatcagataaagaagttccccttatatatcctagtttgcctaatgttctttatcatgcttggttttgaattttaacagatggtttttctgcatctgttgaaataattacattattttcttctttattctgttaatgtggtgaattacattgactggattttaaaacaagataaaaatttgttttccttatagcagtctaagcttcagtaatctagggctgataatacaggtctataatacagggacccagacaatatctttttttttttgctttgttcttccggactcaggttttctctatcatggtct

SEQ ID NO: 30710 - DNA, 876 bp, Homo sapiens
ctaggtgggagggagtccagagggtcatgggtgtgaaactgtgcacagctttccctccctccctcttcctccttgtctgtgacacatgtgcacccacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctgtgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtt

SEQ ID NO: 30711 - DNA, 1122 bp, Homo sapiens
ctaggtgggagggagtccagagggtcatgggtgtgaaactgtgcacagctttccctccctccctcttcctccttgtctgtgacacatgtgcacccacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctgtgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtttgttctttgtgaggctggttaatagcatccccgtgtgtttttctcaccctcgatggggtagaggggcacctgaatgtgtggcccccgtctgtgtcctggatcctggggcagggctgctctccctggcccctgcagcccctcatgaactttccaccctcagtgcccccggctgagcagagaggcgtcccaccattcaaccaaagaaagtcaacattgaacattaaacctctgtgtgtttctatactg

SEQ ID NO: 30712 - DNA, 409 bp, Homo sapiens
caccatagtcctgggggacaggagaaggaatgattatcagaacccagcaatagttacgactgtgggcaaggaactatcagtagagaaatacagccactaccaaagctaacagggagtgaaagagggaaataaatgctgtagcccctcactcctcttgccctgcagtttcattggccattagccaaagcctactgaaagccagagggtaagaggagctgggtgatatagtcatgaggtcagctcctgagagcacagagcaaagaaggtccaagaacggatttggagtgaaaatagagaataatgagcttcttattaatgatttattttgaaacctagaatcaaaagccaatttaaatatctatttttaaaagttcaaattatgactcaggggcatttcctttaaaaaaaa

SEQ ID NO: 30713 - DNA, 290 bp, Homo sapiens
ttttttctgtccctttcttttttgctcttcttctggaactccattaatattagtactaatttagtatgctggatgatgcatcataggtcccttaggctctcttcatgtcgtgtatctttattgtttttcatcctgcttctcagactgataatataaattgcactaatttcaagtttgctgattctttctttgcctgctcaaatctgtcattgaaactctctaatggttttcctttttgatttcagctaacttactttcaactcctaaatttctcttttgttcactttata

SEQ ID NO: 30714 - DNA, 1002 bp, Homo sapiens
  misc_feature (617)..(617): n is a, c, g, or t
  misc_feature (648)..(648): n is a, c, g, or t
  misc_feature (914)..(915): n is a, c, g, or t
atgcaggccgctgggcacccagagccccttgacagcaggggctccttctccctccccacgatgggtgccaacgtctctcaggacaatggcactggccacaatgccaccttctccgagccactgccgttcctctatgtgctcctgcccgccgtgtactccgggatctgtgctgtggggctgactggcaacacggccgtcatccttgtaatcctaagggcgcccaagatgaagacggtgaccaacgtgttcatcctgaacctggccgtcgccgacgggctcttcacgctggtactgcccgtcaacatcgcggagcacctgctgcagtactggcccttcggggagctgctctgcaagctggtgctggccgtcgaccactacaacatcttctccagcatctacttcctagccgtgatgagcgtggaccgatacctggtggtgctggccaccgtgaggtcccgccacatgccctggcgcacctaccggggggcgaaggtcgccagcctgtgtgtctggctgggcgtcacggtcctggttctgcccttcttctctttcgctggcgtctacagcaacgagctgcaggtcccaagctgtgggctgagcttcccgtggcccgagcnggtctggttcaaggccagccgtgtctacacnttggtcctgggcttcgtgctgcccgtgtgcaccatctgtgtgctctacacagacctcctgcgcaggctgcgggccgtgcggctccgctctggagccaaggctctaggcaaggccaggcggaaggtgaccgtcctggtcctcgtcgtgctggccgtgtgcctcctctgctggacgcccttccacctggcctctgtcgtggccctgaccacggacctgccccagaccccactggtcatcagtatgtcctacgtcatcaccagcctcanntacgccaactcgtgcctgaaccccttcctctacgcctttctagatgacaacttccggaagaacttccgcagcatattgcggtgctga

SEQ ID NO: 30715 - DNA, 628 bp, Homo sapiens
tgactagttttggtgtcaaggtgatacctcagagtgacttaggaagaatttcattatcctgaatttttgggaagagtttcaggaggattattattcttagtgcatttggtagaatttggctgtccatttatctactcccgagcttttctttttcaagactttttttattactgcctcaatcatgctactcattattggtttgtgttactgttgtatccattgaaatgtctgttctttcacttctgattgtttatttagatctgtcttctgcttttggttaagctagctagcagtttatcaattttgtctttttgaaaaatcaactattctgttgatcatttttattgtttttggtcttaaattcatttggttctgttctgatttttgtttttttttttcttgtaacttggaatttggtttgttattaattttctagttccttgaagtgtgatgtcaagtccttaatatgtaagctttctacttttttgatgcaggcatttaggctataaactgctctctttgtactatatttgcatatctcacaggttttattatattgcatttctatttccatcttttttcccacaatttttaaattttcattttaattttctttttgagatgggtt

SEQ ID NO: 30716 - DNA, 300 bp, Homo sapiens
gctttgggaggatattgcctcagaggggctttcaggggagctagaaatgttctctgtcttgatctgagtgatggtttcatgagtgttttcccatgtaaaaccatcatcacttcatgtatattaaactaccatttaggaatttcaataggcagtttaaacagcagagtagatagaatgagtgaaccattctgaaagaaccaaggaaactgcctgaaacatgagacagacagaaaaggagataaaagatataaaagaagtgaaacgggataaaatgagtagatcactcatatatccaacaga

SEQ ID NO: 30717 - DNA, 464 bp, Homo sapiens
caccttttcaattagtatattcttcttgtaccttccagtatacactctatttaataccagaacccataagaaacaaatttagtaaaaatccagtgctgggattacaggcgtgaaccaccgcgcctggcccgactaattcatttattcagcgagtgttttctgagcacctactatgtacttgccactgttctaggcactggggatacaggaatgaacaaaatcacccaaatctctgccctcccaattttctggtatggagagaaagttcttttgtagatagggatgagaatcccacagaaaactcaggagtgatgtaacaatgcaaatgctcacaaaatctctttcctcatctttcattccctatttggaaggaaaggtttcaaagacattgatgttgtataaatgaccatcttcttcattattttataaacatttgtcctgtgcagagtaaaaacaactggact

SEQ ID NO: 30718 - DNA, 354 bp, Homo sapiens
tcaggataataagtggttcattttgtatgtataaccataagaaaactcttgcttttatttgctttatactgctcagacaaagcaaggtaaaagtacttcctccttcactttcaacgcattctcatactgaacacaaatacttattaatgatgtggacacctttcattttacccaaatttcttaaaagcctattgcctgagtgtctaatgcaagccctcaactcactcctaaccccatttcaccctccatatgatgccaggtgggccatgctccccgtgcctgcgatgctggaatgccttttcctctcctctcactttccacctgttggatgtttccatgtttattaaggcaagt

SEQ ID NO: 30719 - DNA, 459 bp, Homo sapiens
cagccaacactcagtgctttctgtgcatctgtgcttggctgctttcagttgtccaattatttatcttgtttctgtatttgtccatgttgtctcctccagagagtgcaaactttttgaagtcagtcattaattttatgaagaaatcctggtatgtttttgaagcatctcattgaatatttcataatttaatgaagagattggatgattttggacagtattacatacggaaaagctacatgatacatatttgtggtaccagaacaatgctattaaaatcagcccatgatgtttctgatgagattgcaaagtttgtgtcgagtcttaagtctgtatatgaaacaattaaattctatggaaagagactgccacagaaaaagaaaataggaattaactaaggaaaacataaaaatcacctttttagttgatttttgaaacccaagatactttgtttttatattc

SEQ ID NO: 30720 - DNA, 418 bp, Homo sapiens
atgtgctttttttcccccagctttgactctctggatgcttttgaaagtttgagttcctaagaaattccacagctagaggttcctacgatgtcactgagtgaggttaaggttctgctcttatagggagcatcttatccttggggattctggacaactggacccctaggaacttgaaaaacagctgctttcattggtattcttttgacatggggaaaatatagccattgtccattaaaacacaatccaatttgggtacaagtactcttcaggttttctaagttctccacaggaataccaagactaggctaccatcttttctgacaacagactactttttaaataagctttgtaagtccaagatttctggcagagaaatgtaaataaaaaataaaaacaaaaataaataagtcttgtagaa

SEQ ID NO: 30721 - DNA, 1883 bp, Homo sapiens
aggaataccgctccagcgccaacgcaatctcctcctccctcgcctttacctaatcccttgcctgccctgtttccccgctgagctcctcaaacacttcgcatctctccccgttattccagtctacctggtgaaaaggttatttgaggaccttgtctacgctgcccctacctgatcccgctcccggcgccacaggctgggccccaacaggagctcctcaatctaagtgtctaggagaaacccagggagtctccacgaaggaggcactttacccactacagactaaaactggcctcggaatcgccttcctggagattcggcccagcggctctcaggagtcggtaggggcaagaacgtttccccggtgcagtggaagaagactgcgggccagccagggactcgggatccggggacagggcctcggcaggcgcccgcctggaagcccgcagcccagacgcggacgacccactgctcagcgggacacacctcgggccttgccccggaacgccgcttggacaacaacctttccgccgagtgcaggccgagcgcttttgggcgcagcacgcaggaaccggaagtcaatggaggaagactggacctactgattcaacttggagatgagcgggtctgtcctcttcacggcgggagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggcagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaaatgcagtggggaagcattttgaactgatgattggtgactcccggactagtggaaaagagctagtgaagcagtttctcttcgattctatactgaaggcggatcctcgggtgttcttcccatcagataaaatagttcactacagacagatgtttttatctactgaactacaaagagtagaagagctttatgattcattattacaagctattgccttctatgaattagcagtgtttgactctcagccttagaattctgaggttaacgtgctaaagtataattattagctctaacgtaacaccaactgttgtgaacatccatgttattggaaaagaacacattttcagtgtattttagatgtttaaattctgacttttggctattaaatggtttacacaataagccaagaccaaatcaataaacattttatgagattc

SEQ ID NO: 30722 - DNA, 1846 bp, Homo sapiens
aggaataccgctccagcgccaacgcaatctcctcctccctcgcctttacctaatcccttgcctgccctgtttccccgctgagctcctcaaacacttcgcatctctccccgttattccagtctacctggtgaaaaggttatttgaggaccttgtctacgctgcccctacctgatcccgctcccggcgccacaggctgggccccaacaggagctcctcaatctaagtgtctaggagaaacccagggagtctccacgaaggaggcactttacccactacagactaaaactggcctcggaatcgccttcctggagattcggcccagcggctctcaggagtcggtaggggcaagaacgtttccccggtgcagtggaagaagactgcgggccagccagggactcgggatccggggacagggcctcggcaggcgcccgcctggaagcccgcagcccagacgcggacgacccactgctcagcgggacacacctcgggccttgccccggaacgccgcttggacaacaacctttccgccgagtgcaggccgagcgcttttgggcgcagcacgcaggaaccggaagtcaatggaggaagactggacctactgattcaacttggagatgagcgggtctgtcctcttcacggcgggagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggaagaattgcctgggctcaccttgatcgtaagttgacagtgctggactggcagcaaagtgaccgttggagtttaatgagaggaatatactcatcatcagtctatttagaagagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaaatgcagtggggaagcattttgaactgatgattggtgactcccggactagtggaaaagagctagtgaagcagtttctcttcgattctatactgaaggcggatcctcgggtgttcttcccatcagataaaatagttcactacagacagatgtttttatctactgaactacaaagagtagaagagctttatgattcattattacaagctattgccttctatgaattagcagtgtttgactctcagccttagaattctgaggttaacgtgctaaagtataattattagctctaacgtaacaccaactgttgtgaacatccatgttattggaaaagaacacattttcagtgtattttagatgtttaaattctgacttttggctattaaatggtttacacaataagccaagaccaaatcaataaacattttatgagattc

SEQ ID NO: 30723 - DNA, 1542 bp, Homo sapiens
  misc_feature (1221)..(1221): n is a, c, g, or t
  misc_feature (1225)..(1225): n is a, c, g, or t
  misc_feature (1241)..(1241): n is a, c, g, or t
  misc_feature (1244)..(1244): n is a, c, g, or t
  misc_feature (1255)..(1255): n is a, c, g, or t
  misc_feature (1257)..(1257): n is a, c, g, or t
  misc_feature (1259)..(1259): n is a, c, g, or t
aggaataccgctccagcgccaacgcaatctcctcctccctcgcctttacctaatcccttgcctgccctgtttccccgctgagctcctcaaacacttcgcatctctccccgttattccagtctacctggtgaaaaggttatttgaggaccttgtctacgctgcccctacctgatcccgctcccggcgccacaggctgggccccaacaggagctcctcaatctaagtgtctaggagaaacccagggagtctccacgaaggaggcactttacccactacagactaaaactggcctcggaatcgccttcctggagattcggcccagcggctctcaggagtcggtaggggcaagaacgtttccccggtgcagtggaagaagactgcgggccagccagggactcgggatccggggacagggcctcggcaggcgcccgcctggaagcccgcagcccagacgcggacgacccactgctcagcgggacacacctcgggccttgccccggaacgccgcttggacaacaacctttccgccgagtgcaggccgagcgcttttgggcgcagcacgcaggaaccggaagtcaatggaggaagactggacctactgattcaacttggagatgagcgggtctgtcctcttcacggcgggagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggtatattcttcatgtctgctatactgcctaatatttgagaacctactctagaaagcactcttctgggcattgggtgggaagtggtaagacagggtcttcaggtttagttggnagtntatgatcactaccaantantgagatgtccngntngtaaaatggcagttgagagggcagcaaaccaatggctgtgactgtggtggaaggtttagctgggaaaactcaattatgtcttaaagaagaatccttggatgggaaaggggattgtaggttgaaagaacgttgtgctggaagcagttaaggaaggtattagagaggtggggaaaaacagcgtgtaagggagtggtaagaaaataggcaaatgtttgcgggggttaattacgcgtcggataatattgggtcctagatttgaagggtgtgaaaaaacacttttggg

SEQ ID NO: 30724 - DNA, 1608 bp, Homo sapiens
aggaataccgctccagcgccaacgcaatctcctcctccctcgcctttacctaatcccttgcctgccctgtttccccgctgagctcctcaaacacttcgcatctctccccgttattccagtctacctggtgaaaaggttatttgaggaccttgtctacgctgcccctacctgatcccgctcccggcgccacaggctgggccccaacaggagctcctcaatctaagtgtctaggagaaacccagggagtctccacgaaggaggcactttacccactacagactaaaactggcctcggaatcgccttcctggagattcggcccagcggctctcaggagtcggtaggggcaagaacgtttccccggtgcagtggaagaagactgcgggccagccagggactcgggatccggggacagggcctcggcaggcgcccgcctggaagcccgcagcccagacgcggacgacccactgctcagcgggacacacctcgggccttgccccggaacgccgcttggacaacaacctttccgccgagtgcaggccgagcgcttttgggcgcagcacgcaggaaccggaagtcaatggaggaagactggacctactgattcaacttggagatgagcgggtctgtcctcttcacggcgggagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggcagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaactgcggggggacgcctttgactgtgatggggcccggccattggagagctctggggcgtcctcggccaaaggagggggcccggggttccccaaaaaatctcaccgggttttcttggacccgaaagtgtttcaacagccccataggagcccccccaccacg

SEQ ID NO: 30725 - DNA, 1827 bp, Homo sapiens
aggaataccgctccagcgccaacgcaatctcctcctccctcgcctttacctaatcccttgcctgccctgtttccccgctgagctcctcaaacacttcgcatctctccccgttattccagtctacctggtgaaaaggttatttgaggaccttgtctacgctgcccctacctgatcccgctcccggcgccacaggctgggccccaacaggagctcctcaatctaagtgtctaggagaaacccagggagtctccacgaaggaggcactttacccactacagactaaaactggcctcggaatcgccttcctggagattcggcccagcggctctcaggagtcggtaggggcaagaacgtttccccggtgcagtggaagaagactgcgggccagccagggactcgggatccggggacagggcctcggcaggcgcccgcctggaagcccgcagcccagacgcggacgacccactgctcagcgggacacacctcgggccttgccccggaacgccgcttggacaacaacctttccgccgagtgcaggccgagcgcttttgggcgcagcacgcaggaaccggaagtcaatggaggaagactggacctactgattcaacttggagatgagcgggtctgtcctcttcacggcgggagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggacagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaaatgcagtggggaagcattttgaactgatgattggtgactcccggactagtggaaaagagctagtgaagcagtttctcttcgattctatactgaaggcggatcctcgggtgttcttcccatcagataaaatagttcactacagacagatgtttttatctactgaactacaaagagtagaagagctttatgattcattattacaagctattgccttctatgaattagcagtgtttgactctcagccttagaattctgaggttaacgtgctaaagtataattattagctctaacgtaacaccaactgttgtgaacatccatgttattggaaaagaacacattttcagtgtattttagatgtttaaattctgacttttggctattaaatggtttacacaataagccaagaccaaatcaataaacattttatgagattc

SEQ ID NO: 30726 - DNA, 1105 bp, Homo sapiens
caagacaatttaatattgtcctctattagttcttaaattccaggaaagtatttgtgactttgcaaaggatctagtcaagcttgcaactaaccccaaaggaagtaggacatccaacttatattttgctaaattttccttttagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggcagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaactgcggggggacgcctttgactgtgatggggcccggccattggagagctctggggcgtcctcggccaaaggagggggcccggggttccccaaaaaatctcaccgggttttcttggacccgaaagtgtttcaacagccccataggagcccccccaccacg

SEQ ID NO: 30727 - DNA, 1691 bp, Homo sapiens
gagagacaatgtcacacttcaaggaggcagctctctagacaggaaagttattcacgtcccatgtcaattgagaaatgcaattttatctgctgcctttcattctataccctgcttctgaaccatcgtgttcaactgtgaaactcacactttggtgaccacgactccaaaactcacttaatacacccaaggtcagccccagtgatctgcttcatagcaaggactttgggtgggtctgcccagggagtagggcaccctcagagaatgtggctttggactttatcacagctggggccttttgtgtcacttaagatctaaacttgtaaccatgctagatgtgtttctaatgtgacaacatcacgaaccacgagtccagaagcctaatccttaatcctacctcctcatgatgaagtctcatgctctgtgctcaacgtggttagcctgcacaagatgtaaaccaaagcttcactgaaccctcgacccaaatcagtaactcaagtgcgtcaatcataatgaacctccccaaactcagtttttatgattatttttgaggcagggtctcactctgtcgcccagactggagtgcagtggcaggatcagggctccgtgcggccccgaccttccaggctccagcgatcctcccgcctcagcgaggctgaagcacaagaattgtgtgaacccaggaggcggaggttgcagtgagttgagattgggccactccattccagcctgagaggcagaacaagactctgtctcaataaacaaacaaacaaacaaactgtccaggtgtggtggcacagccctgtagtcggagctaataaagaagctgaggtgggaggatcgcttgagcccaggatatggaggctgcggtgagctatgatctcaccactgcactccagcttgggggacagggcaagtctgtctcaaaaaaataaaagaaattgaatacattgatattttgccaggaccctgccttctacaggcatctagtctaatgggactgggagtaatcaaggcagatgacctaatcccagtgtccaggatgtaactagagagctacgggcatgcagaagttggaagatgagggaaggcatcacagaggctgtggggtgaactgatttcaaggaatgggtccttcccttcagagccacatgtgtgcgggacacccagacagaaaacacaaacacaaagtcgagtggagggcatttggaaggagcagtgaagccgagccaggaaataccaagatggcgagccagtgtgcttgtagagattgtagagagggtagaattgacactgtggaccctggcctcgatagagaaaggcatcagctaaggaagttgttcaggtgggcagtgaggttgtcgtgctttggaaagatgttcaggctgcactaggaagccccctggcttggggagagactccaggagaccccagcggggagcatttgacagtaaattcgagtgatgcgagggggacctgaactgtggcctctgtcatgggaacccagaggaggtcgatggcgtttgtggttgatgtgggaaggagagagagagaagaaccagaaacgtctgcttgctggaggaagcggcatgtccgctcctccactccttttcttttccccttaggagcggtttatggttccttttgttttattcttttatttgtacactggcattggagtttgtttttttggc

SEQ ID NO: 30728 - DNA, 1376 bp, Homo sapiens
  misc_feature (1262)..(1262): n is a, c, g, or t
  misc_feature (1264)..(1264): n is a, c, g, or t
  misc_feature (1347)..(1347): n is a, c, g, or t
gagagacaatgtcacacttcaaggaggcagctctctagacaggaaagttattcacgtcccatgtcaattgagaaatgcaattttatctgctgcctttcattctataccctgcttctgaaccatcgtgttcaactgtgaaactcacactttggtgaccacgactccaaaactcacttaatacacccaaggtcagccccagtgatctgcttcatagcaaggactttgggtgggtctgcccagggagtagggcaccctcagagaatgtggctttggactttatcacagctggggccttttgtgtcacttaagatctaaacttgtaaccatgctagatgtgtttctaatgtgacaacatcacgaaccacgagtccagaagcctaatccttaatcctacctcctcatgatgaagtctcatgctctgtgctcaacgtggttagcctgcacaagatgtaaaccaaagcttcactgaaccctcgacccaaatcagtaactcaagtgcgtcaatcataatgaacctccccaaactcagtttttatgattatttttgaggcagggtctcactctgtcgcccagactggagtgcagtggcaggatcagggctccgtgcggccccgaccttccaggctccagcgatcctcccgcctcagcgaggctgaagcacaagaattgtgtgaacccaggaggcggaggttgcagtgagttgagattgggccactccattccagcctgagaggcagaacaagactctgtctcaataaacaaacaaacaaacaaactgtccaggtgtggtggcacagccctgtagtcggagctaataaagaagctgaggtgggaggatcgcttgagcccaggatatggaggctgcggtgagctatgatctcaccactgcactccagcttgggggacagggcaagtctgtctcaaaaaaataaaagaaattgaatacattgatattttgccaggaccctgccttctacaggcatctagtctaatgggactgggagtaatcaaggcagatgacctaatcccagtgtccaggatgtaactagagagctacgggcatgcagaagttggaagatgagggaaggcatcacagaggctgtggggtgaactgatttcaaggaatgggtccttcccttcagagccacatgtgtgcgggacacccagacagaaaacacaaacacaaagtcgagtggagggcatttggaaggagcagtgaagccgagccaggaaataccaagatggcgagccagtgtgcttgngntttctgtctgggtgtcccgcacacatgtggctctgaagggaaggacccattccttgaaatcagttcaccccacagcctctgtnatgccttccctcatcttccaacttctgca

SEQ ID NO: 30729 - DNA, 543 bp, Homo sapiens
tagaatatgtctcatgtggacagcatatagatctggtgcgtctttgaggtcgtcagagctcatgggcttccctgaaattcatccactgtccctgccgtatgctacgggaatattcattagtgtacaaaatgcagggaggaagtaggtttaatattcaactttctagccaaagtttatattgaaacccaaaagaaaacatttaagagttgttccacatatttcacttttaaaaacaaatgcctttggttctttagcacattttgcattccttttcacatctccagtaaatgccaacatatctcctgttaaattagcagcagccatttaaagtcctttcggtggcatctgcataataattgcccagagatgctttatatctgggaagcaagccaaggaataaaccttgaagcaaagtgtattaaattagttatctagttagagcttttggaatgatttcctgatgatgtatcaagtctgaagctggagctgtcagtgtctattgctgcagtttggatttgaagggagaaaatgtaaaatggagga

SEQ ID NO: 30730 - DNA, 433 bp, Homo sapiens
agctgggactacaggcgcacactgccgtgcctggctaattttttgtgttttagtagagatggggtttcaccatgttgcccaggctagtgttgaactcctgagctcagacaatccgcttgcctcggcctcccaaagtgctaggattacaggcatgagccaccgcacccggccccggaatctgcatttcaacaagctcttctgatggttcctctgcatctgggagtcgagaagttcttgctctatggcctctgaagttgcttcgaacccaattcagaatctcaacccactcctctgcctcttctagtcatagttacttttccttaagtgccacactggcataaaggcgttcgatgttccactatctttcctgcaggtgttcagcacatgatcggtggtttctagggtctgccatgggtcttactaattatttgga

SEQ ID NO: 30731 - DNA, 1553 bp, Homo sapiens
gccgcgggagccgaagagggcgccccaggtggttgccccctccctctcctgagatgtcaggaaggagggggccacctgtgtcctccacaggggccccccgaagcctggggactcccagccccagagctccgaggcggaggaggtgctgacaggtgctccgagagatgctccctctcccctcatgctccctccccatcctcctccttttcctcctccccagtgtgccaattgagtcccaacccccaccctcaacattgcccccttttctggcccctgagtgggaccttctctccccccgagtagtcctgtctaggggtgcccctgctgggccccctctgctcttcctgctggaggctggggcctttcgggagtcagcaggtgccccggccaaccgcagccggcgtggggtgagcgaaactgcaccagcgagtcgtcggggtgagctggctgtgtgcgatgcagtcagtggctgggtgacagaccgccggaccgctgtggacttgcgtgggcgcgaggtggaggtgttgggcgaggtgcctgcagctggcggcagtcccctccgccagtacttctttgaaacccgctgcaaggctgataacgctgaggaaggtggcccgggggcaggtggagggggctgccggggagtggacaggaggcactgggtatctgagtgcaaggccaagcagtcctatgtgcgggcattgaccgctgatgcccagggccgtgtgggctggcgatggattcgaattgacactgcctgcgtctgcacactcctcagccggactggccgggcctgagacccatgcccaggaaaataacagagctggatgctgagagacctcagggatggcccagctgatctaaggaccccagtttgggaactcatcaaataatcacaaaatcacaattctctgattttgagctcaatctctgcaggatgggtgaaaccacatggggttttggaggttgaataggagttctcctggagcaacttgagggtaataatgatgatgatataataataatagccactatttactgagtgtttactgtttcttatccctaatacataactcctcagatcaactctcatggatttgatcattggtggcccttggtgttaagttgctgactactcagtctcagaggacaccaccttgctggggagtgggaggggacatttcacgatgtgggtggaggaggagagaaactagaacaggcaagcagatggccaggggaccttgagaacgtggcccacagaaggcctttaagtatctgggagatggggttcaaatgggaaatcttacttggtaagagggggcaaaggttgacttagaatattctgttttgaggtaataagctaccgatcacagaggagtacaagcaaggttgaatgagaagtgatcaggatgctggagagttcagccctcggcagggagctgaagtcaggtttctagccctcttccctgtcccaacctttactctacattgggaaagaaacagaccttaaaattttccagcttgatggccaggtgcgatggctcattcctgta

SEQ ID NO: 30732 - DNA, 894 bp, Homo sapiens
cccttccccacctgcctctataacctgtctattcttttcttcccctaggtggttgccccctccctctcctgagatgtcaggaaggagggggccacctgtgtcctccacaggggccccccgaagcctggggactcccagccccagagctccgaggcggaggaggtgctgacagtgagagacctcagggatggcccagctgatctaaggaccccagtttgggaactcatcaaataatcacaaaatcacaattctctgattttgagctcaatctctgcaggatgggtgaaaccacatggggttttggaggttgaataggagttctcctggagcaacttgagggtaataatgatgatgatataataataatagccactatttactgagtgtttactgtttcttatccctaatacataactcctcagatcaactctcatggatttgatcattggtggcccttggtgttaagttgctgactactcagtctcagaggacaccaccttgctggggagtgggaggggacatttcacgatgtgggtggaggaggagagaaactagaacaggcaagcagatggccaggggaccttgagaacgtggcccacagaaggcctttaagtatctgggagatggggttcaaatgggaaatcttacttggtaagagggggcaaaggttgacttagaatattctgttttgaggtaataagctaccgatcacagaggagtacaagcaaggttgaatgagaagtgatcaggatgctggagagttcagccctcggcagggagctgaagtcaggtttctagccctcttccctgtcccaacctttactctacattgggaaagaaacagaccttaaaattttccagcttgatggccaggtgcgatggctcattcctgta

SEQ ID NO: 30733 - DNA, 1663 bp, Homo sapiens
ggggcggggcttggcggaggaaactgaggcaagagggaagtgtcccagatatgcagccggtttcccctgaggggtctcggagtccggaacccccaacccaaatctggaggatgaggaacccggagtctgcatttcttagtggttgccccctccctctcctgagatgtcaggaaggagggggccacctgtgtcctccacaggggccccccgaagcctggggactcccagccccagagctccgaggcggaggaggtgctgacaggtgctccgagagatgctccctctcccctcatgctccctccccatcctcctccttttcctcctccccagtgtgccaattgagtcccaacccccaccctcaacattgcccccttttctggcccctgagtgggaccttctctccccccgagtagtcctgtctaggggtgcccctgctgggccccctctgctcttcctgctggaggctggggcctttcgggagtcagcaggtgccccggccaaccgcagccggcgtggggtgagcgaaactgcaccagcgagtcgtcggggtgagctggctgtgtgcgatgcagtcagtggctgggtgacagaccgccggaccgctgtggacttgcgtgggcgcgaggtggaggtgttgggcgaggtgcctgcagctggcggcagtcccctccgccagtacttctttgaaacccgctgcaaggctgataacgctgaggaaggtggcccgggggcaggtggagggggctgccggggagtggacaggaggcactgggtatctgagtgcaaggccaagcagtcctatgtgcgggcattgaccgctgatgcccagggccgtgtgggctggcgatggattcgaattgacactgcctgcgtctgcacactcctcagccggactggccgggcctgagacccatgcccaggaaaataacagagctggatgctgagagacctcagggatggcccagctgatctaaggaccccagtttgggaactcatcaaataatcacaaaatcacaattctctgattttgagctcaatctctgcaggatgggtgaaaccacatggggttttggaggttgaataggagttctcctggagcaacttgagggtaataatgatgatgatataataataatagccactatttactgagtgtttactgtttcttatccctaatacataactcctcagatcaactctcatggatttgatcattggtggcccttggtgttaagttgctgactactcagtctcagaggacaccaccttgctggggagtgggaggggacatttcacgatgtgggtggaggaggagagaaactagaacaggcaagcagatggccaggggaccttgagaacgtggcccacagaaggcctttaagtatctgggagatggggttcaaatgggaaatcttacttggtaagagggggcaaaggttgacttagaatattctgttttgaggtaataagctaccgatcacagaggagtacaagcaaggttgaatgagaagtgatcaggatgctggagagttcagccctcggcagggagctgaagtcaggtttctagccctcttccctgtcccaacctttactctacattgggaaagaaacagaccttaaaattttccagcttgatggccaggtgcgatggctcattcctgta

SEQ ID NO: 30734 - DNA, 1702 bp, Homo sapiens
ggggcggggcttggcggaggaaactgaggcaagagggaagtgtcccagatatgcagccggtttcccctgaggggtctcggagtccggaacccccaacccaaatctggaggatgaggaacccggagtctgcatttcttagtatccgagaaggaggggcctgaattccagaactcctgggtggttgccccctccctctcctgagatgtcaggaaggagggggccacctgtgtcctccacaggggccccccgaagcctggggactcccagccccagagctccgaggcggaggaggtgctgacaggtgctccgagagatgctccctctcccctcatgctccctccccatcctcctccttttcctcctccccagtgtgccaattgagtcccaacccccaccctcaacattgcccccttttctggcccctgagtgggaccttctctccccccgagtagtcctgtctaggggtgcccctgctgggccccctctgctcttcctgctggaggctggggcctttcgggagtcagcaggtgccccggccaaccgcagccggcgtggggtgagcgaaactgcaccagcgagtcgtcggggtgagctggctgtgtgcgatgcagtcagtggctgggtgacagaccgccggaccgctgtggacttgcgtgggcgcgaggtggaggtgttgggcgaggtgcctgcagctggcggcagtcccctccgccagtacttctttgaaacccgctgcaaggctgataacgctgaggaaggtggcccgggggcaggtggagggggctgccggggagtggacaggaggcactgggtatctgagtgcaaggccaagcagtcctatgtgcgggcattgaccgctgatgcccagggccgtgtgggctggcgatggattcgaattgacactgcctgcgtctgcacactcctcagccggactggccgggcctgagacccatgcccaggaaaataacagagctggatgctgagagacctcagggatggcccagctgatctaaggaccccagtttgggaactcatcaaataatcacaaaatcacaattctctgattttgagctcaatctctgcaggatgggtgaaaccacatggggttttggaggttgaataggagttctcctggagcaacttgagggtaataatgatgatgatataataataatagccactatttactgagtgtttactgtttcttatccctaatacataactcctcagatcaactctcatggatttgatcattggtggcccttggtgttaagttgctgactactcagtctcagaggacaccaccttgctggggagtgggaggggacatttcacgatgtgggtggaggaggagagaaactagaacaggcaagcagatggccaggggaccttgagaacgtggcccacagaaggcctttaagtatctgggagatggggttcaaatgggaaatcttacttggtaagagggggcaaaggttgacttagaatattctgttttgaggtaataagctaccgatcacagaggagtacaagcaaggttgaatgagaagtgatcaggatgctggagagttcagccctcggcagggagctgaagtcaggtttctagccctcttccctgtcccaacctttactctacattgggaaagaaacagaccttaaaattttccagcttgatggccaggtgcgatggctcattcctgta

SEQ ID NO: 30735 - DNA, 432 bp, Homo sapiens
gggactcccagccccagagctccgaggcggaggaggtgctgacagtctggtaactactgactgtttcccagtcttctccacgccaccctttcccagaaccacaggcttccagaatgttgtagggaaactgcaaaatccgcgcctccaccagcctctcccagcgccaggtcaatttcacacacagggaaactgaagcctgcctcagaggggcagcgttttacctccttagtggcagttttgaggtgaactggggtctccctaggattccaggttgtgacctttctctaaattgtggaatgtggccaggcgtggtggcttgagtctgtagtcccagctactcaggaggctgaggcaggagaatgccatgaacttgggaggcggagcttgcagtgagccaagatcgtgccactgcactccagcctgggcgacaga

SEQ ID NO: 30736 - DNA, 1558 bp, Homo sapiens
tgcatcaacattcttcccccacgtcttgacgctgggttccggcctagggttctggctttcctcctgggctagtgaacgcggcgaagtcctcctctttctaatctccagagccgcagttccatcctctgggtcagcggcttaccctgactgggctgcggtatctgccttccttcccccaacaaggcgacaggtagtcggggctggggccggaactgactgagtgggccgcaactgactgagtgggccgcggctcccgcctgaggaggctaggaaggactgaacagcagccgacttcccaggctctaaaaatcgtgcctctgagttagagctacctcaaaagcaagaccaagcatgagaaatggagtcttttggccagtattggggtgttcggaattcaagcgtatgagagagtggacggtagcgttgagaattttcatttgaagatctcgtcttaaccaccccaagtgtagtcagaggcggcgttttccctgcgagagtgccctggaacaaagcaaggatagcgtgggttagacatacctgaaatgaaagcgtcttactttatctaggtacatatttgcgtcagtaaggcgcaacgccatttctctcttggaattcagaagtgaaatatggtgactgggacgcctgtacattgctttgacttaaaaattgaagtccattattctgaccgaaagttaatctgatgattaattggttaaacatactatcgttgctaattagcataattattatttacaataaagtgagctaaatagctacaactaaaatatatttaaattactgtgatattgtgatgctaaagatgtgttgaaattaatatcttgaatttctcaaccctgcctaaatgcctctgagagtaattagtataattaaaagtcactagagaaagtgaatgactctaataacaggataacaaattcttttcaagtcagatggtttccagttctttgctttcaacaaaattaatggtggcccatgaattgtcagctgatgaaggaacactatttggtttttggcatgcaactcggaaagaaaccaaacgattgattgacatgcttacaacaaaactactagcattctcacctatttatgtaaaaccatttctcagcacttgtatctgtgaaaacaacagaattgaaaatgaaccctgttaatctaccagtaggaactattcatccagataaatgaattaattggtgggtcagccccatctatctcactaagagatgtgttcccaatagaatttcaccttttataactgtgtgttatcaatatttgcaatcgtgtcattttgatccattatatactaaagatgattgtgatgattactcacttcagaagaattccagcgtagagccataaagttacacgaaattttttaaggtttactacatatgtcatatttttattgcgaagaagtgatcaagaaaaggttgttcaaacatcaaagtactatatttgaataacattttttgttagagtacaatctaaatatgttagagataataaaagaacaatgttgaagagctcaaaaaaaaat

SEQ ID NO: 30737 - DNA, 991 bp, Homo sapiens
aagggagggctcgaagcttctcccggggtcgtcgcaagaaaaaatgcaagatttgcaagcttcgatcctttttccgtaaactcaacaccaggctaatgtcccaacggatctgatggtggggagggagaaaactgtcctttagaggatcttccccactccggcttggccctgctgtttctcagggagaagcctgtcacatctccatctacagggagttggagggtgtagagtcccttggttgaacagggtagggagcctggataggagtgggtgggaataaaccagactgggatgcctgtgtctcagtcctgcctcctcacggacttgctctgtgacctcaggtgacccacatgagcttttagcctcagtttcctcatctgtaaaatgagctctaatgactttgtgactctttggtgtggccctggagcctggggcacggtggagttcctggccggccttgccacttgacaactcctttaaggcttcccccttaacacgggatccctgtggtggtgtttgggagttgcctggaggcaactccaagcctggcccccagctgaagcatggcaatctggctgctctctacagggacccccaagcgctgtgggtggagggcaggggtcgggggggttgaccttcttgggtcttcacatggcctaggccagtcctccggtcagactggtgtcaggcaccgtggtgcaaaattcctcttctggcccctccagtacccagagaaactggctgggccattaactgctgcagcaccaagggtggtagaaagagctgtgaagagcccccaaaccagtaccaggacacctgggttctcctgtgacctggggcacagttcttgccctctaggccttgatttccccacctgcaagtggggatgccagccctggctctgcctccttcatgaggctctggaagactggccaaggttgtggaggagcttgtgaacttgattaaagtgtcgtaacatggaaatgaaaaa

SEQ ID NO: 30738 - DNA, 390 bp, Homo sapiens
ggggcctaggctttgtccacagtcccctgctcaagcgaaagcaacggacaagccgggcactgatgcacatcactgaactggtgtcaggcaccgtggtgcaaaattcctcttctggcccctccagtacccagagaaactggctgggccattaactgctgcagcaccaagggtggtagaaagagctgtgaagagcccccaaaccagtaccaggacacctgggttctcctgtgacctggggcacagttcttgccctctaggccttgatttccccacctgcaagtggggatgccagccctggctctgcctccttcatgaggctctggaagactggccaaggttgtggaggagcttgtgaacttgattaaagtgtcgtaacatggaaatgaaaaa

SEQ ID NO: 30739 - DNA, 390 bp, Homo sapiens
aaataattcaaatcactgccaatgcagtgtgttacaagtataaatctaaatacagccagttaaaaagagctaatttaattcgcagctgtgttcaatttaaaacatggatattatttaggtcttcatttctttttatgcatgggtgtgctatctcttgcatggcatggaagttgattaactttaaaaatatgaattgggttgcataccacattgttttcccttttgaaattttttttaagtttcttaattgctggagaccattttagggccatggatttaaaaagaaatcattttttcctttagaaatggatgtttgttttaaaagtaaatagaaaaacattaatcctaaatacttttggaattaatcttgcaatcaattggaaacagaag

SEQ ID NO: 30740 - DNA, 427 bp, Homo sapiens
ggtagatgaattgtagaagtttgattatgaagcaaagagaaggatagagatagtagtggaaaggaagaatggacggagcagctgaatccaacaggagagaacttcgaatattatcctcaagatattagaaaataaaaaagggaagacagactgagcacagcgactcacgcctgtaatcccagcactttaggaggctgaggcaggcagatcacgaggtcaggagatcgagaccatcctggccaatatggtgaaaccctgtctctactaaaaatataaaaattagcttggcatggtggtgcatgcttgtaatctcggctactcgggaggctgaggcaggagaattgcttgaaccaggaagtcagaggttgcagtgagccgagatcgcgccactgcactccaacctggtgacagagcgagactccgtctc

SEQ ID NO: 30741 - DNA, 500 bp, Homo sapiens
ctgacctcgtgatcctcccacctcggcctcccaaagtgctgagattacaggcgtgagccaccacgcccagccaaacagttatattttaaagagacccagaaatgacaggaaaaaatcatgttcacctcaccaggtgctcttcgttgctttttgttgtatatccaagttcccatcggagatcatcttcctccctcctgaaggaattgaatgtttcctgtagtgcaggtttgctggtgatacgttcttgtttcttttgcatgtcagaaaaagtctttactttgtcttcattttgaaataaattttcactgggtatagaattctaggttaatttaatctttgttccttcagttaccaatttgtgtcttttctctctctttttctgtggctgcttttaagtttcttctggtttttttgttttgttttgttttcccttagagacaggatctcactgtgtcacccaggctggagtacagtggtgctcactgcagcctcgagctccc

SEQ ID NO: 30742 - DNA, 407 bp, Homo sapiens
ggggagacatgggcttgtcaatctaatggttatagtgactaaaaatagtaacaatgaggcagtacatgtgatcaataaattttaaaatggagagggatgtgtttccatataaatacaaagctttgcatcatttctaacacactggttcaaaagatagcttttttttttgtaccctgtccaaaagcaatgagatgctccttcccataaatcaaacaaccaaagctctgggagagctggcttcccttcttcacatgggaagctgttcataaagcctagttctcgtagagacttaccacctgtattagtccgttttcacactgctacaaagaactgcccagtttataatagctgggtaattataagtaagaggtttaattgactcacagttccacatggctgtggaggcc

SEQ ID NO: 30743 - DNA, 411 bp, Homo sapiens
tactactactactaaattcgcggccggtcgacctgctttattttaccaaagatattggtcctttttttctccagacaactcaacaaatatttactaagttcctacagtgtatccagctatgggcagtacactgtggtatatagtacagtgcttcctctccaaatgccaacaacgaaataatagcgtctttcagtttgtaaagcacttttatatgcataatttcatattattctccctctagtcttttgaaatagaaagtacaggtattatttccattttgtagatgagaaaactaaggcttagtaacttactcaagattccactgatggagatttgtgggtccattctgtttactgactccagtgtgttctgtggtctccatataactcagtttgatttttctctcctcct

SEQ ID NO: 30744 - DNA, 355 bp, Homo sapiens
gaagcgaggccaccaggctggagtgggctcagctgctcaggggaacctatactctccccctctgcctctgccagcctgctcctttctcaggcaggccacctggtccacctggccctggagcccaaacctccctccccaacgtgcttttacactgcctaaatgctcaaatcttcctgttcttagatctagaaaacccttttagtgctgaatccccttcaagctactttcttgctctgtgaagctaactctctctttctcttcaccatcaagcttacatttttttcaaactacagcactcattagattaaaagcattatcaaactcctggcaacagtgatgcaggagccacatacca

SEQ ID NO: 30745 - DNA, 930 bp, Homo sapiens
  misc_feature (798)..(798): n is a, c, g, or t
  misc_feature (800)..(800): n is a, c, g, or t
  misc_feature (807)..(807): n is a, c, g, or t
  misc_feature (813)..(813): n is a, c, g, or t
  misc_feature (819)..(819): n is a, c, g, or t
  misc_feature (821)..(821): n is a, c, g, or t
  misc_feature (830)..(830): n is a, c, g, or t
  misc_feature (840)..(840): n is a, c, g, or t
  misc_feature (846)..(846): n is a, c, g, or t
  misc_feature (860)..(860): n is a, c, g, or t
ctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcaaaaaaaaaaaggggngntaaaatnccgggncagttngnccgttttgnaaggccaagngggaanaaagcggggtaaanggggaaagcggttggggacctcggggggggagccaaaggaaaaaagtgggaggcgggggggtagcgagag

SEQ ID NO: 30746 - DNA, 783 bp, Homo sapiens
ctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagca

SEQ ID NO: 30747 - DNA, 336 bp, Homo sapiens
cagatgaatcgcaattaataaatgtggaacgaatgagagacgaagacgatgagcaccagaggactgcagggagcacggctgaggcaacatcaccagaggatagtaaaattagcagacagagatctaagcacaaacagtgtctctgtgtagccttaaagcatctctttgaatatttaatggttacaaaggaaaaacagtgagttgatgggggagaaccctggcaggcaccaccctaaccaagagatcaaagttggcatgaccaggcacaaggcacactaacagcccacacccactgatctggcccaccgaaaatgcacatcacttctgtggcattgc

SEQ ID NO: 30748 - DNA, 1953 bp, Homo sapiens
tgtatgagagaataaacaaacttactcagactgaagagtatgttttcaaaaattaaagaagtagcaattatatgggagctgttatttattaaagcaattatctgagcccttaaagggctgtttgtttttacaatgttgtataatggccttgcaggaaaattagatttcttattctctcttccagtgtacattgtcttgagtattgtcacatttagagaccatagggagatatgggactcctagtattcagtcgacactctgaacagattttctgtgtgatacattttttcattttaattgagtcccctcttcctcccctccaactgatagctttttataactgtgtgaaatatctagagaagaatgaagtaggctgagctacattttcaagcttaacattctttagaaaactaagaaaatgcccaatatttcaacattaaggtgtcaataggggctaaatgatcactttaagatgttttcagtttggaacttgaatgtgtgtttaattttttgtgaacagattgatgactcttccgcgtctatttctctggcccagcttacaaaggtatatatatatatatattcttgaaaatataagtttttttctaacatcatatttttttatgtggaacggttttttaagaggggttgggggaggacatattttgcaaaagcattgtacatattattactatcctgtaaagagtagttgctgttttgagaagataggggaatactttgtcagcctcagcgtattggagtattgttcatcttcaagacagaagaaacacttgaagctacacttaattattttttttccctcatacattttgtttaattatacattggaaactaacaaggttctggaggaatttcctggttttggctataaattatgtggaccttttttaagcagccaaaacagaagatttcctttacacggacgattgcatggttatttcttgaatatttgacttgatcccatgaaggtcaatattttaaatgtgatgcagttgtttctttatgctatagacttgtagtctgtctgcattaggaaaagttttgaacaacctaatttgtttgaacacagactacatgaattgtgtaagtgtgtaaagctgtttgcaggaatataccaatgtgtatgtttggcagaggggcaaattgttacctcctgaatcactgtatatgccatgttttgcgataagattgcttgcattttctgctcaacaatgtgtatcttctgtttgggaaagcactagtgatggattactttttaaagcaatacatttagcttgcaaattgtgcctttaaaaaaaaaaataggcagacttttgagggccaagaaggaagctgtccagttttccaaaaatcctttttccctgctatcagaaatgtgaaaccaaatttagcaaccaagattaatgaaaagatgggttttccattagtgctgtccctatcttgttcttggctttgttatgtcctttcccctagactgtatcccgacaaaatgtcctagtaacaaattgctttttaagctcctgttctgggaaaactaagcattaaaattgattattctaaaacataaagtggactaaagccatcctattttataattttctaatgcaaagtggtttagtatagagttaacacttagaagtttatagtttactgtttttattcttatgtactgtaaggaccatatttgagtttttggtctattcctaccattgtttctttgtggggaggagttggggcggtttgggggattggttttttttttttgtttttttaaactacaggtatttgtaaaacaatgtttgggttcaaacaaattagttgttaaacatctgtaatccagttttctgtaaatgttgctgttgttctaagctctgttaatgttaagcattctttgtatataaaattacaataaaatgttaaaactgaaaactt

SEQ ID NO: 30749 - DNA, 384 bp, Homo sapiens
tcttggatggtggtgatttgggggtgggcatgggatgggtaggggcaggtggtgtactgcctacaggataaagctgctctcatttgtaattactgtggggaggtgaggcaaggggggaggctgttctggcttttctaatttcaaaagatgcctaaaggacataataggagctacatgcttttcattcacaaatagttacaccagagaatgctaactggggtttgctaccttaagtggcaaggaatctcttggagcagttggggggcatcattatcttgtttatgtgcaaaagaagatttaagtagatgaaaagatgatttttatctagacaaaatgttcctaccatcctgcatgtataacccaattgcctcatgttaaagtcat

SEQ ID NO: 30750 - DNA, 464 bp, Homo sapiens
cactagaaaaagaatattaataaccagttagaggagtaaatatagtgttaactaaagcacatggaaattaagaaagaattagacttttgatgctaacttgttgtatgttaactatattcccccaagggcaaaaaatatttaattcacagaaagttttctcatccttattttccaaggagaacatttttagtctcaaatcacaataaaatcatattttatactttaaatgtgttctacctccctaaagttaactgaaatatagtccttaggatataatagcatcgtatgtgagtaattgagaaatttaataaatgcaagtatttagaaagaaagaaaatgttctgtttccaaaagcagatatattactaccactggcaaaactctttcataataaattcttaattatatttcagcatctcccaaagtgttatctcagtgtgaataaccatcatacagctcagcat

SEQ ID NO: 30751 - DNA, 429 bp, Homo sapiens
ggaatttggtagcttctcagaataatggctgcacgaacaatatttgtttaattttggtctagtaggtaacggaatcaagtctgtgttgtatgaacgtatgataaatgtgtgatgatgagggggatgatgatagtgatgacaaacttcaaggttgtcttgatttttctggattcctccatcttggacatttcctatcctgttccttggtttaggaatgaatatgtgatacaattctggccaacgagacatgagggtaagttttcagttcagggagtcaagtgaggaaaaaggtgggatgaaacagcatttgacatgcataggtttacttaagcccctgatgttcagtaaggtatccctccttcagttgtgcttggtgcctttgagtcttgagatcttcttcttctgttttatattctccaaagaaaaaac

SEQ ID NO: 30752 - DNA, 948 bp, Homo sapiens
gattgcttgagcctaagaatttgaggctgcagtgagccatgactgcaccattgcactctggcctgggcaacagagagagatcctgtctccaaaaaagaagaaaagtatcaagcctcagctcaggacatgattccgaatctgcatctcaacgagactctgggtgatttgtgtgcacagtagtttgagaagctctggggcctaccacatagccctcaacctattgctgttttctaaaattcctacacaaactccgttcctgacagacttgccatgatggagcagcattgcaggatcactacagggaatattaataatgagtcttcaaatcaggaaccccactagacagagccaccaactgggcagtacgtcagcactaatgggtgacaatttcctaggcactcctgggtacaagtccataaatgtaattggcaccaagcaatagagttgtcacagctttcacctgccgcattagggcaaactgcttttatgtctaaaccactgggcctgaaagcttcctctaagtagagcctggaattaatcttgatccactgtaattcaaagtatcgtcagattttcatttcccagagtgggagcgcgccccccattgccatgttttatggccttgtttgagcctctacaagtgcttgtttggcagcgatattcagaatcacccaaaccatggggatgttctgctaggtaattagccccaggccagtggactcaatttttttataacattttcagaaaaatatgtgacccaaggaggggacttggctgttcagctgcagcctgcatgggaaagaactgttaaaaccaacaaagccaggcacagtggctcacacctgtaattccagcattttgggaggccgaggtgggtggatcacctaaggtcaggagttcgagaccagcctgccaacatggcgaaaccctgtctctactaaaaataca

SEQ ID NO: 30753 - DNA, 267 bp, Homo sapiens
cccacgcgtccgcggacggcgtgggtcgacccacgcgtccgaaaccttgtttgccagttaccttccgaaagctgtgtaaagagttatttttaacaaagtcttaacaatatatgttactttttagatactatagaaaataataaatataacctgtaaaccacattaagctatgtttgtttttaatttgataaatcacattggcaactttgtgtagtatactttttaaaaataagctttacattaaagtttgttaattcaggcttaaaa

SEQ ID NO: 30754 - DNA, 1258 bp, Homo sapiens
ttttttcattttcttctcatttacacctatttttttaaaaagtatacatttactaaaatgatgtaataaataacatgttaatagactcaagctttaccttatgaaattgatgtatttttaccagttatttctaatgtaacattgaatatataagatctgacaaatgtatgtttaaacatgaattagaagagttgagaactaccattatgtatagggattctcatagtgtcttggcccttaattggaaagttgtggcaactttaaagtactttttactgtatgttataattctttataacttagagagagacaatggtcactcaaactatgagaactatgaattaggagataaaagtttaaatttgttgttgttttataacagtatgtacaagttagttttcccttatatatttacgttttcaagttttttaatctcatcatatacatccatactctataaaatgttttatattcaaagaactgtaaaatcctaaacattagttttcactattgaaattgttttttaaagataggcataaatagttgtccttagacttattcatacaaatatagtcatttacttctatgtagtttgagattctgagagttattccaactttatgaagattgatttcaatgtgcctgctaagtcctaaaagattcagaaagaaaatttatatattattgatttaaatatcatcctttaaatatgttgtataacattcaatatagtttatgtatcagtgattgtattttattctgaatgcatgatctcaagccttaactactataatctttttctgcccctcagaaattgaataacctaaccaagatgcctttaggggatgccctaagtaaatgtaatttcagatttcagggttttttttttttcctctctaagtgttccttccctttcttctcctgctctccatcatgttatggagaccagtgaggaaccagtgttaacttggtgacaatgtgacagctggtgctttatctaagctccgttttctatttcttgggaatgctttattgtggaaactgcttcagatacttaaattgaatcataacttgcttctgtaaattgcgtaaagacaacaaactgattttagtttgaaaagtttatcttttacttgtaaaccttgtttgccagttaccttccgaaagctgtgtaaagagttatttttaacaaagtcttaacaatatatgttactttttagatactatagaaaataataaatataacctgtaaaccaca

SEQ ID NO: 30755 - DNA, 1151 bp, Homo sapiens
ttttttcattttcttctcatttacacctatttttttaaaaagtatacatttactaaatgtatgtttaaacatgaattagaagagttgagaactaccattatgtatagggattctcatagtgtcttggcccttaattggaaagttgtggcaactttaaagtactttttactgtatgttataattctttataacttagagagagacaatggtcactcaaactatgagaactatgaattaggagataaaagtttaaatttgttgttgttttataacagtatgtacaagttagttttcccttatatatttacgttttcaagttttttaatctcatcatatacatccatactctataaaatgttttatattcaaagaactgtaaaatcctaaacattagttttcactattgaaattgttttttaaagataggcataaatagttgtccttagacttattcatacaaatatagtcatttacttctatgtagtttgagattctgagagttattccaactttatgaagattgatttcaatgtgcctgctaagtcctaaaagattcagaaagaaaatttatatattattgatttaaatatcatcctttaaatatgttgtataacattcaatatagtttatgtatcagtgattgtattttattctgaatgcatgatctcaagccttaactactataatctttttctgcccctcagaaattgaataacctaaccaagatgcctttaggggatgccctaagtaaatgtaatttcagatttcagggttttttttttttcctctctaagtgttccttccctttcttctcctgctctccatcatgttatggagaccagtgaggaaccagtgttaacttggtgacaatgtgacagctggtgctttatctaagctccgttttctatttcttgggaatgctttattgtggaaactgcttcagatacttaaattgaatcataacttgcttctgtaaattgcgtaaagacaacaaactgattttagtttgaaaagtttatcttttacttgtaaaccttgtttgccagttaccttccgaaagctgtgtaaagagttatttttaacaaagtcttaacaatatatgttactttttagatactatagaaaataataaatataacctgtaaaccaca

SEQ ID NO: 30756 - DNA, 1786 bp, Homo sapiens
tgaaatgatctggcattatctatttcacagtaatgtaaaatgcttatttttatgtcaccagttgtcaccactcccattgctgatagtgacataggttttgggggcaaaattcagttcctaacaaacagtggatactgctaatgagtcatcttttctactctcttcaattttctactctctactctcctctttaatttttgcacaaaataatactttgcaacaaatagtcttttgtctttattggcagaaaaatcacttgttatatgtgttctagttagttctttttcatgttagctgtgtggctaaaagcgtgttacctttctatatttaaaaaaagtaatctctgaggatagttacagttcctgtaatataattttatgtacctagttttatctttttttaaataagaactgaagagagagctttgttacatatttgaatttttaatttgcactgctgtattttaaacctaaccataattagtcatttaaaataattaagtaggcctgaaagtcagccatgttaatttctcaatttaatcaattcttaaagccttcaaaaattgacattttttttccaagacccttcattctcttaaataactttaattttatgaaaccatgtatactaaagaaaaacttttccaagattccaggtgattgtgcatttgtgctctaatctacttttttaacattacggctaatcttttgcgtagacatatcgctgtggaataactgccatatttcagagttcctcaggtttccttttccttttccagtctctgtctatgaattaaatagtatatagaatgacccatataaggcaatatagttaaataaaaccaggttaaatgatttcctttgtatctgcccaaagttgatagcacacgttactttttcaaaataaagctaaaactaccaaaaagaggatgaaaactttttcctcattatggagtgaagttctaggtggttgctttagaagttggcagtgcagtgctcagaaggaactctcaataaataacatgtactccttggacctgtgagttttaggaaactggaccttttctgaagaccttagaatagggagttggccttaggacctaatgtcccaacttagtgttggacccttttaatataagatattgttaattattagcatacttttcaaaacctttgaaatagttactgctaacctgataaaatgttcccattaatctatcattagtctgtttctctgaaaacaaaatgcattgatgaggtgaaagcttgttccacatggcacctacctaatgaacaggacttactcagtttttaactgttaagaatgtcacatgtactattgtcactccttaggttttcagctataaaacatgtaagtctctcatcatacagatgaattcatttgctaacaaaatatttaaaacccgcagtagactctgaaatatccagtcatcaaactcctggctaactggatgatttggctataataatctttattattattattttcatctgtctctcgaaatatctacagtaggatgttagtaaatggtcttttaaaagcaaaaaattggggataaaaggaaaactgaattccttctatatttttattactaataaataatgcttttgtaaatttgaatggaaaaccacttgtatgtattgctatttggttgcagttacactctggagcttaatttaaaacactactctaaaaatttcatgaaggatgaattccaataatcagaaaataaatgcatttcaaagctaaaaataaagtgtgatat

SEQ ID NO: 30757 - DNA, 460 bp, Homo sapiens
caacttataaagtctgccagagtgttcgtggttacgactttctaggggtctgctttgtgatatggattaatatttactgtccttcacttgaccctttgtcacattgtgtgattattttttctagtttacttttttttcccatgtaaaactttttatttaacatttctgtaatcagaactctcaatcttttgtttaaaacttggaaagcattcctcacatatttaattttgctacatgcatgattttttaaatgctaaacctttgattcataaggaatatatttttgtttgggtttaacccgttattccaatagcaacaccactttattaaacagtcttttatgtcttcactcacttgatatgccatcttcatgtgttgttgttgttgttttttgagatggagtcttgctctgtcgcccaggctggagtgcagtggcatgatctcggctcactgcgacctc

SEQ ID NO: 30758 - DNA, 461 bp, Homo sapiens
ggagtttcctaagcaatgggtgcttagcaaggcagtactgtgggcggggtgggagcggggcctctgcaggacagtggcctccctcccctcgttctgactcagccggaggaaggagcctcagtcccgcagcatccgaggttatgcagaggtacaggtggcttgttacctccactaccacctggcctgctgctcacttgctgggagggaggatgaagcggagtgctgggcaggggctgccaatgttggatgctcacttgctcccaaacaggtttggggtccacagtctcaatgcagaggagagtgggggatgaggaccttctctcatttaacccccacactagccctctgaggccagggtaactgtgccccttttataggtgaggatcagagaggctaagggacttgcactaataacagctagcagggggcagagccgggacagaagcagtgctccatcccag

SEQ ID NO: 30759 - DNA, 473 bp, Homo sapiens
tgaaagcgcgggcggagggtgcgcttgtgttcttgagacccaggttccattacaaaccacccagcatcgccaccggcgccccccgtttcaataaggaagccactttgtcaaaacattctaaaagaaacttgggaagaggacgcgtcagagaaataccgccgccgattaactatcagctgcgcctcccctgtgcacagaaagcatgcagcagagatcagaggaagggccatttggtccagagagaccctgattcacagccttgtcctgttccaagcaatgttgggatgagctgaagaagatgcctccgttctcagacccaaaaggcacaaagacggcacctttgggagagccaggcactaccagtgtcttgagtgctgaatattgtgcattcgaaagcaatgagagctctagggtggacctttcactggcactcaaagagaaccaaggaagcagagaaggatgataaatggcat

SEQ ID NO: 30760 - DNA, 432 bp, Homo sapiens
acaaaatccatctgggcaacggctctatggaaaatttggcttaagtaattatttccagtattccattgtattccattgtcccttcgtgttccataagttaaatgactgtctaatttttccaaaaatttatttctgacttgagaataagtgtgtcatgattttcccagtgtaaagacactgatataactgtagataccagacattttatgtagtgtctatgacacattttagtatgtatgagccaacaatagacatgtctttgtcttgaggagtgtccatctgaattgaaaatgtgtcagcttttttttaacatcatcaacagacttcttaattaagctgccaatacatactgccaatagcactgtgtgctgtctgagaaatgcattgtgtaagtgctatttccatcttattaaataaacaatgttgctctgt

SEQ ID NO: 30761 - DNA, 333 bp, Homo sapiens
ggcgtggtggcactcgcctgtagtcccagctacttgggaagctgaggcagaagaatcgcttgaacccgggaagtggaggttgcagtgagccgagatcacaccactgcactacagcctggcgacagaacaagactccatctcaaaataaataaataaataaataaataaataaataaataaataaataaataaatggtaccattatctccgcagcactttaaaagttgtatgatttctgacactaactttaatgttaaatgttattctatcacatagataaggttcttaaaaaacaatgtcaaaacaaaaatattaggttatttcctattcact

SEQ ID NO: 30762 - DNA, 460 bp, Homo sapiens
atatcagtaatcactgattatgatcagtgtggaattttgggaagcaggagcaagttaaagggaaacgtgtgctgtaaattatagactgaaagtttggtatcagtcccaaagtattattcagatggtttgtgagcatttagagtacctaaagagcaaatcatggatttcataaacatgggagagactagaagcattctgcagcaataagtggaaaacatccttggccaggggcaaatggttgatgaatctaacagggtgataagtaataggaataaatctaaatccttcctgtatggttcaaaaaagccaagagtactggcttggaattagagtaatacaatttagcagcaatatgtatgaagaagagattgaggatttggcttcaatgcaaatgaatctacaatatcatccatcttgtataaattatccctgtgatgttagtgcctcaccatcccctgca

SEQ ID NO: 30763 - DNA, 350 bp, Homo sapiens
taaagctaagcccaaaaatgtagtattcatgggaataactcatttttaaacagaacaaaattttcattgtggtaaagacacgtaacaaaatttaccatcttaaccatttttaagtctatagtttagcagtgttaagtatattcacatcgttgtgaggcaatcttgaataatgatttgtttttgactgactgctattattcaatactcaccatgtactaggttataggatgtgaaagtgagacacagtgcctggtttcaaggaactgtgtggaaagggaagacacatgtgcacagacacagaactgataccaccacgcagagcagaagctgcatgagggctattgcaatat

SEQ ID NO: 30764 - DNA, 1143 bp, Homo sapiens
gacaatagctgagttgagaagacctcaaggatatttaaaggaatttttctgctactgaaaatatattgaagaatcgctgcaaaatttttccattccatcccctttcccccacccccgttttccacagcaagaatcaatttggagggagatgtgtaaactagaatttttaaagaaatagtaagacttcaggtgttttctacccagggatagcctacataattgagaaagaggagttcctgctatttttctgttccagagagaaatgtatcaaatcttttttagaattccactggagttttgattctcaaagtggaaatacccatccctttgggtccaggaaaagaaaactcagctcacagtttcagaaatttggactgttttttttcccccctctgtctttctatttgaaacgtctcacaattaaagagcaagaaaaatataaaaaaggaactcaactagttaccattcaaaaggtgtcagctaaaatctcactgcaaagggaaaaaaaaaggtttaacatcttgccactggctgcatcccccaccccccttagactttggattagtcattgtatgagagagagggagagaaaaaaaaatcacttttttttttttttgggaaaagtaaagtaaacagcctccaactgctggaaccttggacaacccaaattaaggaagcaggagagatcaaacagaactgctgctgggtggttgtcaggagctgctacacggagaaccctggactattcgatcaagcagcaaggctatatgttcacttatgcagaaatggaccattgcagatgctaatctttgttgtgcaagcgaaggctcacttggaaggaaatactcagcccctctctgggcagcatttgagttccttatggatgccgagtcgcgaaacaagttattttttttaatgtatccttctttatgaggagaatgctacccaaaaatgtattaaaggaatattaagtcgtccagagactgtcttgctaccaagaactgtgcaatggaattctttttaccaacattagactcctacactagagttagataacgttttctcacattgagtttagaagatctgccttgtcagggaagccaaggttttgtatgtgagagtttaaatctgatgtgaagctca

SEQ ID NO: 30765 - DNA, 416 bp, Homo sapiens
taatggctgaatggaattccattgtgtatatgtaacacattttccttatccagtcatccactgaggaacatacaggtggacttcatctctccactgttgtgaataatgctgcaataaacatgggagtgcaaatatgttttctacatactgatttcattttctttaaatatatacccagtcatgaaattgctagattatgagatagctgtattttgatttcttgaaaaactccatgttttctataacagctgtttgtaaatagaattgtcttattgattttttttttcagataattcactattagtgtatagaaatgctattgactttggtatgttaatttggtatcctgcaagtttactgatttgtttcttagatctaatcatttttctgacgtgggctttggagttgtctatatt

SEQ ID NO: 30766 - DNA, 353 bp, Homo sapiens
atacattcttgtcttctacacatgcaacatattctgtgattgaccatatgcttggccataaaacaaatctcagtgaatttttaaaaatgatgccaagcacactctcagaccacagtgccataaaaatggaaattaatactaagaagatttctcaaaactacacaaaaacatggaaattaaacaactagctctttataacccttgagtgaacaatgaaattaagtcagaaataaaaactttctttgaaactaatcaaagtagagatgcaacttactaacatctttgggatgcagctaaatttgtgctaagagataagtttatagtcctatggctttcatcaagaggttagaaag

SEQ ID NO: 30767 - DNA, 471 bp, Homo sapiens
ccttgtctctaaaacaaacaaaaccactacatttactcatcctttaagtaccaacatgttacctcctgtgagaaaattttccagaaataccatttaacacactaatagacatgtctctcgattgctctattgctgatcaattgtgtatttctccaagttggcctcctaatataccccaacccctctttcttcaagttggaagccacatttatgtagcttgaatattaaagttacgtatgtaaacatttaaaagcaggtgagtttgttaacttcggcaagcttatcagtagacagggccttccagtgaaaagagcacttgactagaaattaggagatttaggtactgtcctaaatctgtttctaccttactttctctggcctcagttttctccctcataaaggaatgtatctacagccctagtctctgggtggcgatttacggcttctctgccttttatcttcattctccga

SEQ ID NO: 30768 - DNA, 408 bp, Homo sapiens
gccctggcaacatagcaagagcccgtctttataaaaaataaaaattaaaaataaatagcgagccatggtggtagcacatgcctgtagtcccagctacttgggaggctgagacagggaagatcacataagccccaggagttggaggctgcagtgagctacgactgcaccactgcactccagtctgggtgaaagctcaagaccctgtctccaaaaaagaaaagaaaaaaattctaatataaatatgtaacccgaagttcatgtttcctcattaattttagtggtattaggccaggaacggtggctcatgcctgtaatgccagcactttgggaggccgaggcaggagctcgcttgagcccaggagttcaaggctggcctggcaacataggaagatcttgtctctaccagaa

SEQ ID NO: 30769 - DNA, 204 bp, Homo sapiens
tttttttttgtattttttgtggagacggggtttcaccgtgttcaccaggatggtctcaatctcctgacctcatgatccgcatgcctcagcctcccaaagtgctgggattacaggcgtgaaccaccacgcccagacctctggttaattttttagaacttgaaaattagagctgtattttaccatgttaaagatgtgttcttagcc

SEQ ID NO: 30770 - DNA, 770 bp, Homo sapiens
cactttaggggccgaggtgggaggatcacttgaagctaggagttagagactagactggacaacaaagcaagatcctgtcaaaaaaagaaagaaaagaaaagagaaaaagaaagaattccagaagaggatggtacttttgagactcaccactcttatttaccattgagaaacctatggcacagaaatagaaagtgatgacctcaaggttacttacaaattagtagcaacactattctaaagcactgttgtccaaaatggtagtcactagccacatatagctatcaaacactagaaatgtggcggaagaactggattatttattttacttaattttaattactataaatatcaatagttacatgtagctagtggcttccatgttggatagcacagttcttgagtctaaatgtctagttcagggccttctcctcctaaatgacatggcctccaaaaggggggtattgtttccaaattcagaattagcataaggaaaaaaataaaaatgtaggaactctgagaactgtgaggttgacaactaccaaggatggaattttagtgtacttaacagaaattcatcattctgtttggttttcccttagttccttagaaaaagttccttttgaaaacaccacaggatttctggttttcaaatgatatctaacttgtaggaccctaatggcagcctcactcaggctcctgatttcaaaaactggggaatcaactgtcatcctatcacccaaatttgggtgataggataacacgtgcgcgag

SEQ ID NO: 30771 - DNA, 1171 bp, Homo sapiens
cactttaggggccgaggtgggaggatcacttgaagctaggagttagagactagactggacaacaaagcaagatcctgtcaaaaaaagaaagaaaagaaaagagaaaaagaaagaattccagaagaggatggtacttttgagactcaccactcttatttaccattgagaaacctatggcacagaaatagaaagtgatgacctcaaggttacttacaaattagtagcaacactattctaaagcactgttgtccaaaatggtagtcactagccacatatagctatcaaacactagaaatgtggcggaagaactggattatttattttacttaattttaattactataaatatcaatagttacatgtagctagtggcttccatgttggatagcacagttcttgagtctaaatgtctagttcagggccttctcctcctaaatgacatggcctccaaaaggggggtattgtttccaaattcagaattagcataaggaaaaaaataaaaatgtaggaactctgagaactgtgaggttgacaactaccaaggatggaattttagtgtacttaacagaaattcatcattctgtttggttttcccttagttccttagaaaaagttccttttgaaaacaccacaggatttctggttttcaaatgatatctaacttgtaggaccctaatggcagcctcactcaggctcctgatttcaaaaactggggaatcaactgtcatcctatcacccaaatttggacgggcttttcaccaactcaaaactgatgaaactagagtaaatagcctcaatcagtggactatttatgaaatttctccctaaacattgattcctcacctattgagggagccaggactgtaccggccagtcttcaaaaggcagttaatgggccaggtgcagtagcacatgcctgtaatcccaacattttgggaggccaaggtgggaggatcacctgaggtcagaagttcgacaccagccctgccaacatggccaaaccccatctctactaaaaaaaaaaaaaatttagccgggcatggtggcacgcacctgtagtcgcagctacttgggaggctgcacatgagaatctcttgaacctgggaggcagaggtcgtaatcagccaaaattgtgccactgcactccagcctgggcgacagagcgagactc

SEQ ID NO: 30772 - DNA, 291 bp, Homo sapiens
  misc_feature (2)..(2): n is a, c, g, or t
  misc_feature (6)..(6): n is a, c, g, or t
  misc_feature (8)..(8): n is a, c, g, or t
  misc_feature (11)..(12): n is a, c, g, or t
tnagangnagnntcactgttgttccccaggctggagtgcagtggcactatcacagctcactgcagccttggaactcctgagctcaaatgatcctcccaccccagcctcccaaagtgctggggttataggcatgagccctgtgcctggctaatgattaatgttattacaaatatttaaatggtgaagtccatgtctcaaggatgtccagactaaacatccaaaagagataagaactatttgatgtagattttctgtgatgtattatctttttctctctaaggaaaaaaaaaa

SEQ ID NO: 30773 - DNA, 316 bp, Homo sapiens
cacccgcttcggcctcccaaagtgctgggattacaggtttgagccactgcgcccggccaactgtgggttctgatgtactcagcctccctagtggacagtgcaccagtgcactcacagggtttatgctagggagtacaacggttcacagcaacgcggcggcaagggcttaacatttgtgaggtgggctccagcagcagcagggcatggaacactgggcttcctggggcagccccccattcttagaggtgatggcagcagtcagcccacacccacagcatttcccagccctggcccccccatctcagcctctgtgtgg

SEQ ID NO: 30774 - DNA, 1576 bp, Homo sapiens
agcgggttgccgcgatccgggccgggagctgcgggcgcccgggcgcccgaggcttcccggtgcgctccgccaggtgctgtgcagcctgtgtggctggctctcgctctatatttctttctgccacctgaataagcaccgaagctatgagtggagctgccgcctggtcaccttcacccatggagtcctctctataggcctctccgcttatattggcttcattgatggcccatggccttttacccacccaggctcacccaatacacctctccaagttcatgtcctgtgtctcaccttgggctacttcatcttcgacttgggctggtgcgtctactttcagtctgagggtgccttgatgctggctcatcacacattgagtatcttgggcattatcatggcccttgtgcttggggagtctggcacagaggtcaatgcagtcctctttggaagtgagcttaccaaccccttgctacagatgcgctggtttctccgggaaacagggcactatcacagtttcactggagatgtagtggacttcctctttgtggctctgttcacaggagtgaggattggtgtgggagcttgcctccttttctgtgaaatggtctcccccacgcctaagtggtttgtgaaggctgggggagtagcgatgtatgctgtgtcttggtgtttcatgtttagcatctggcgctttgcatggaggaagagcatcaagaagtaccatgcttggagaagcaggcggagtgaggaacggcagctgaaacacaacggacatctcaaaatacactagccaaggcttgctccagattatggattgggttaagtcagccatgggaaccaggttggaaatatgactgttacataattacacttataacaaacttaggtttcaataaagggctaaatgtattgatcaatttggtcagtcttcaagccgagcatataccagtattaaaacactaacttctacagtagcacagttgtagaaagtgagaatactccatggtagttgggaataagtgagaactgtgaagtgagtacaactggcatttgttttcatttgtggtgaccctgggtcctcctgtccctgggaggtttgatgttcaggcagtttagaaaggaactcgaaaaagattagtgctatttcttgttcctttgagaagtaactctttcaataaacacttatttctgctttccacatagcaatttatctaagtttaccccatttactataaagtgaggggcttacaggaagagacacgcctttgacattctgaacattagatcggggaattgggtcgcttaaacagaggggcataggagggtgagagtgaaactggcagtgagggggagggctacttactgaacctcctataccaactgtgccagaggtgcccaagaccactgccaggttctgtaattctctgggaagactcagtggactcagcatatagtcttacttatagttttgatttattatagtgaaaagatacaaagaaaaatcggtaaaaggaaaaggcacctgagacaaagtctagggtaaagcaagcacaagtttccagagtcctctcccaatgga

SEQ ID NO: 30775 - DNA, 1209 bp, Homo sapiens
  misc_feature (10)..(10): n is a, c, g, or t
  misc_feature (13)..(13): n is a, c, g, or t
  misc_feature (15)..(15): n is a, c, g, or t
  misc_feature (17)..(17): n is a, c, g, or t
gcgggcgcgngcngngncatctcccggtgcgctccgcagatggcattagctctgtgtctgcaggtgctgtgcagcctgtgtggctggctctcgctctatatttctttctgccacctgaataagcaccgaagctatgagtggagctgccgcctggtcaccttcacccatggagtcctctctataggcctctccgcttatattggcttcattgatggcccatggccttttacccacccaggctcacccaatacacctctccaagttcatgtcctgtgtctcaccttgggctacttcatcttcgacttgggctgcatctggcgctttgcatggaggaagagcatcaagaagtaccatgcttggagaagcaggcggagtgaggaacggcagctgaaacacaacggacatctcaaaatacactagccaaggcttgctccagattatggattgggttaagtcagccatgggaaccaggttggaaatatgactgttacataattacacttataacaaacttaggtttcaataaagggctaaatgtattgatcaatttggtcagtcttcaagccgagcatataccagtattaaaacactaacttctacagtagcacagttgtagaaagtgagaatactccatggtagttgggaataagtgagaactgtgaagtgagtacaactggcatttgttttcatttgtggtgaccctgggtcctcctgtccctgggaggtttgatgttcaggcagtttagaaaggaactcgaaaaagattagtgctatttcttgttcctttgagaagtaactctttcaataaacacttatttctgctttccacatagcaatttatctaagtttaccccatttactataaagtgaggggcttacaggaagagacacgcctttgacattctgaacattagatcggggaattgggtcgcttaaacagaggggcataggagggtgagagtgaaactggcagtgagggggagggctacttactgaacctcctataccaactgtgccagaggtgcccaagaccactgccaggttctgtaattctctgggaagactcagtggactcagcatatagtcttacttatagttttgatttattatagtgaaaagatacaaagaaaaatcggtaaaaggaaaaggcacctgagacaaagtctagggtaaagcaagcacaagtttccagagtcctctcccaatgga

SEQ ID NO: 30776 - DNA, 1920 bp, Homo sapiens
agcgggttgccgcgatccgggccgggagctgcgggcgcccgggcgcccgaggcttcccggtgcgctccgccaggtcagtcatcgctagagggttattattgacatttactcatcataaaatgtgatgtcagcctaccagctcggagtgcagttcctggtttccagtttacaacattgaccagttgctaacatgttatctctgaggaacttggaatgataaatacagccatacttaaatagaagattcttggccgtgtagataaggaaaataagataaggcaatatttttgaactattctataatagaaatgaggatatatacacaaaatgacccagtgctgttttcttagggtgcatcctttgtttttctggttttggtcttttcatcacaggatggcattagctctgtgtctgcaggtgctgtgcagcctgtgtggctggctctcgctctatatttctttctgccacctgaataagcaccgaagctatgagtggagctgccgcctggtcaccttcacccatggagtcctctctataggcctctccgcttatattggcttcattgatggcccatggccttttacccacccaggctcacccaatacacctctccaagttcatgtcctgtgtctcaccttgggctacttcatcttcgacttgggctggtgcgtctactttcagtctgagggtgccttgatgctggctcatcacacattgagtatcttgggcattatcatggcccttgtgcttggggagtctggcacagaggtcaatgcagtcctctttggaagtgagcttaccaaccccttgctacagatgcgctggtttctccgggaaacagggcactatcacagtttcactggagatgtagtggacttcctctttgtggctctgttcacaggagtgaggattggtgtgggagcttgcctccttttctgtgaaatggtctcccccacgcctaagtggtttgtgaaggctgggggagtagcgatgtatgctgtgtcttggtgtttcatgtttagcatctggcgctttgcatggaggaagagcatcaagaagtaccatgcttggagaagcaggcggagtgaggaacggcagctgaaacacaacggacatctcaaaatacactagccaaggcttgctccagattatggattgggttaagtcagccatgggaaccaggttggaaatatgactgttacataattacacttataacaaacttaggtttcaataaagggctaaatgtattgatcaatttggtcagtcttcaagccgagcatataccagtattaaaacactaacttctacagtagcacagttgtagaaagtgagaatactccatggtagttgggaataagtgagaactgtgaagtgagtacaactggcatttgttttcatttgtggtgaccctgggtcctcctgtccctgggaggtttgatgttcaggcagtttagaaaggaactcgaaaaagattagtgctatttcttgttcctttgagaagtaactctttcaataaacacttatttctgctttccacatagcaatttatctaagtttaccccatttactataaagtgaggggcttacaggaagagacacgcctttgacattctgaacattagatcggggaattgggtcgcttaaacagaggggcataggagggtgagagtgaaactggcagtgagggggagggctacttactgaacctcctataccaactgtgccagaggtgcccaagaccactgccaggttctgtaattctctgggaagactcagtggactcagcatatagtcttacttatagttttgatttattatagtgaaaagatacaaagaaaaatcggtaaaaggaaaaggcacctgagacaaagtctagggtaaagcaagcacaagtttccagagtcctctcccaatgga

SEQ ID NO: 30777 - DNA, 1566 bp, Homo sapiens
  misc_feature (10)..(10): n is a, c, g, or t
  misc_feature (13)..(13): n is a, c, g, or t
  misc_feature (15)..(15): n is a, c, g, or t
  misc_feature (17)..(17): n is a, c, g, or t
gcgggcgcgngcngngncatctcccggtgcgctccgcagatggcattagctctgtgtctgcaggtgctgtgcagcctgtgtggctggctctcgctctatatttctttctgccacctgaataagcaccgaagctatgagtggagctgccgcctggtcaccttcacccatggagtcctctctataggcctctccgcttatattggcttcattgatggcccatggccttttacccacccaggctcacccaatacacctctccaagttcatgtcctgtgtctcaccttgggctacttcatcttcgacttgggctggtgcgtctactttcagtctgagggtgccttgatgctggctcatcacacattgagtatcttgggcattatcatggcccttgtgcttggggagtctggcacagaggtcaatgcagtcctctttggaagtgagcttaccaaccccttgctacagatgcgctggtttctccgggaaacagggcactatcacagtttcactggagatgtagtggacttcctctttgtggctctgttcacaggagtgaggattggtgtgggagcttgcctccttttctgtgaaatggtctcccccacgcctaagtggtttgtgaaggctgggggagtagcgatgtatgctgtgtcttggtgtttcatgtttagcatctggcgctttgcatggaggaagagcatcaagaagtaccatgcttggagaagcaggcggagtgaggaacggcagctgaaacacaacggacatctcaaaatacactagccaaggcttgctccagattatggattgggttaagtcagccatgggaaccaggttggaaatatgactgttacataattacacttataacaaacttaggtttcaataaagggctaaatgtattgatcaatttggtcagtcttcaagccgagcatataccagtattaaaacactaacttctacagtagcacagttgtagaaagtgagaatactccatggtagttgggaataagtgagaactgtgaagtgagtacaactggcatttgttttcatttgtggtgaccctgggtcctcctgtccctgggaggtttgatgttcaggcagtttagaaaggaactcgaaaaagattagtgctatttcttgttcctttgagaagtaactctttcaataaacacttatttctgctttccacatagcaatttatctaagtttaccccatttactataaagtgaggggcttacaggaagagacacgcctttgacattctgaacattagatcggggaattgggtcgcttaaacagaggggcataggagggtgagagtgaaactggcagtgagggggagggctacttactgaacctcctataccaactgtgccagaggtgcccaagaccactgccaggttctgtaattctctgggaagactcagtggactcagcatatagtcttacttatagttttgatttattatagtgaaaagatacaaagaaaaatcggtaaaaggaaaaggcacctgagacaaagtctagggtaaagcaagcacaagtttccagagtcctctcccaatgga

SEQ ID NO: 30778 - DNA, 2859 bp, Homo sapiens
ccgggatcccgccctggggaggcgcgcagcagaggctccgattcggggcaggtgagaggctgactttctctcggtgcgtccagtggagctctgagtttcgaatcggtggcggcggattccccgcgcgcccggcgtcggggcttccaggaggatgcggagccccagcgcggcgtggctgctgggggccgccatcctgctagcagcctctctctcctgcagtggcaccatccaaggaaccaatagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccatccctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattgagttttccaggtcctcagatgggaattgcacagtaggatgtggaacctgtttaatgttatgaggacgtgtctgttatttcctaatcaaaaaggtctcaccacataccatgtggatgcagcacctctcaggattgctaggagctcccctgtttgcatgagaaaagtagtcccccaaattaacatcagtgtctgtttcagaatctctctactcagatgaccccagaaactgaaccaacagaagcagacttttcagaagatggtgaagacagaaacccagtaacttgcaaaaagtagacttggtgtgaagactcacttctcagctgaaattatatatatacacatatatatatatattttacatctgggatcatgatagacttgttagggcttcaaggccctcagagatgatcagtccaactgaacgaccttacaaatgaggaaaccaagataaatgagctgccagaatcaggtttccaatcaacagcagtgagttgggattggacagtagaatttcaatgtccagtgagtgaggttcttgtaccacttcatcaaaatcatggatcttggctgggtgcggtgcctcatgcctgtaatcctagcactttgggaggctgaggcaggcaatcacttgaggtcaggagttcgagaccagcctggccatcatggcgaaacctcatctctactaaaaatacaaaagttaaccaggtgtgtggtgcacgtttgtaatcccagttactcaggaggctgaggcacaagaattgagtatcactttaactcaggaggcagaggttgcagtgagccgagattgcaccactgcactccagcttgggtgataaaataaaataaaatagtcgtgaatcttgttcaaaatgcagattcctcagattcaataatgagagctcagactgggaacagggcccaggaatctgtgtggtacaaacctgcatggtgtttatgcacacagagatttgagaaccattgttctgaatgctgcttccatttgacaaagtgccgtgataatttttgaaaagagaagcaaacaatggtgtctcttttatgttcagcttataatgaaatctgtttgttgacttattaggactttgaattatttctttattaaccctctgagtttttgtatgtattattattaaagaaaaatgcaatcaggattttaaacatgtaaatacaaattttgtataacttttgatgacttcagtgaaattttcaggtagtctgagtaatagattgttttgccacttagaatagcatttgccacttagtattttaaaaaataattgttggagtatttattgtcagttttgttcacttgttatctaatacaaaattataaagccttcagagggtttggaccacatctctttggaaaatagtttgcaacatatttaagagatacttgatgccaaaatgactttatacaacgattgtatttgtgacttttaaaaataattattttattgtgtaattgatttataaataacaaaattttttttacaa

SEQ ID NO: 30779 - DNA, 699 bp, Homo sapiens
aagcagtggtatcaacccagagtgcccattacggccgggattattaaagaaaaatgcaatcaggattttaaacatgtaaatacaaattttgtataacttttgatgacttcagtgaaattttcaggtagtctgagtaatagattgttttgccacttagaatagcatttgccacttagtattttaaaaaataattgttggagtatttattgtcagttttgttcacttgttatctaatacaaaattataaagccttcagagggtttggaccacatctctttggaaaatagtttgcaacatatttaagagatacttgatgccaaaatgactttatacaacgattgtatttgtgacttttaaaaataattattttattgtgtaattgatttataaataacaaaattttttttacaaactaaaaaaaaaaaaaaaaaaaaaaaaaaactttgttgggcgcgccgcgcggaccccatggaaaagttttctaagaacaatttcgttgggggccggcgggcgccagtggttacagtggacgcgggcaaagcgggtccccaaggaaaacggggcaagggacgagggcggggttcctcaccaataaaaaaagcccgggggacagggggggtctggaccaaacccaaggagtccgaggccacaggggccacacaggggtcaaggagcggattatcggccgcggggggagag

SEQ ID NO: 30780 - DNA, 2816 bp, Homo sapiens
ccgggatcccgccctggggaggcgcgcagcagaggctccgattcggggcaggtgagaggctgactttctctcggtgcgtccagtggagctctgagtttcgaatcggtggcggcggattccccgcgcgcccggcgtcggggcttccaggaggatgcggagccccagcgcggcgtggctgctgggggccgccatcctgctagcagcctctctctcctgcagtggcaccatccagttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccatccctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattgagttttccaggtcctcagatgggaattgcacagtaggatgtggaacctgtttaatgttatgaggacgtgtctgttatttcctaatcaaaaaggtctcaccacataccatgtggatgcagcacctctcaggattgctaggagctcccctgtttgcatgagaaaagtagtcccccaaattaacatcagtgtctgtttcagaatctctctactcagatgaccccagaaactgaaccaacagaagcagacttttcagaagatggtgaagacagaaacccagtaacttgcaaaaagtagacttggtgtgaagactcacttctcagctgaaattatatatatacacatatatatatatattttacatctgggatcatgatagacttgttagggcttcaaggccctcagagatgatcagtccaactgaacgaccttacaaatgaggaaaccaagataaatgagctgccagaatcaggtttccaatcaacagcagtgagttgggattggacagtagaatttcaatgtccagtgagtgaggttcttgtaccacttcatcaaaatcatggatcttggctgggtgcggtgcctcatgcctgtaatcctagcactttgggaggctgaggcaggcaatcacttgaggtcaggagttcgagaccagcctggccatcatggcgaaacctcatctctactaaaaatacaaaagttaaccaggtgtgtggtgcacgtttgtaatcccagttactcaggaggctgaggcacaagaattgagtatcactttaactcaggaggcagaggttgcagtgagccgagattgcaccactgcactccagcttgggtgataaaataaaataaaatagtcgtgaatcttgttcaaaatgcagattcctcagattcaataatgagagctcagactgggaacagggcccaggaatctgtgtggtacaaacctgcatggtgtttatgcacacagagatttgagaaccattgttctgaatgctgcttccatttgacaaagtgccgtgataatttttgaaaagagaagcaaacaatggtgtctcttttatgttcagcttataatgaaatctgtttgttgacttattaggactttgaattatttctttattaaccctctgagtttttgtatgtattattattaaagaaaaatgcaatcaggattttaaacatgtaaatacaaattttgtataacttttgatgacttcagtgaaattttcaggtagtctgagtaatagattgttttgccacttagaatagcatttgccacttagtattttaaaaaataattgttggagtatttattgtcagttttgttcacttgttatctaatacaaaattataaagccttcagagggtttggaccacatctctttggaaaatagtttgcaacatatttaagagatacttgatgccaaaatgactttatacaacgattgtatttgtgacttttaaaaataattattttattgtgtaattgatttataaataacaaaattttttttacaa

SEQ ID NO: 30781 - DNA, 804 bp, Homo sapiens
attttatagttattttaatttatttattctgttttttctgcttgtctgtgttgagaaaatggttttttatatacacactgtttttgtttttgtttttttgagatgcactccagcttgggtgataaaataaaataaaatagtcgtgaatcttgttcaaaatgcagattcctcagattcaataatgagagctcagactgggaacagggcccaggaatctgtgtggtacaaacctgcatggtgtttatgcacacagagatttgagaaccattgttctgaatgctgcttccatttgacaaagtgccgtgataatttttgaaaagagaagcaaacaatggtgtctcttttatgttcagcttataatgaaatctgtttgttgacttattaggactttgaattatttctttattaaccctctgagtttttgtatgtattattattaaagaaaaatgcaatcaggattttaaacatgtaaatacaaattttgtataacttttgatgacttcagtgaaattttcaggtagtctgagtaatagattgttttgccacttagaatagcatttgccacttagtattttaaaaaataattgttggagtatttattgtcagttttgttcacttgttatctaatacaaaattataaagccttcagagggtttggaccacatctctttggaaaatagtttgcaacatatttaagagatacttgatgccaaaatgactttatacaacgattgtatttgtgacttttaaaaataattattttattgtgtaattgatttataaataacaaaattttttttacaa

SEQ ID NO: 30782 - DNA, 542 bp, Homo sapiens
tgaaacatttatttctgtaatgacccttgtcttcctttcttgtacaggaaccaatagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattg

SEQ ID NO: 30783 - DNA, 2440 bp, Homo sapiens
gctgaggcctgcgcgaccccgccagagatggggctgagtcccaatttagacaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccagaagggcctgcagaaactgatcctgaggtgacaccacagctcagctccccagcaccgctgtgtctgacactgcaggagaggctgctggccttcgagcgggaccgtgtgaccatcccagcagcccaggtggctttggccaaacagctggctggcgacatcgccctggagctgcaggcctactttcggagcaagttcccggaactgccctttggggcattcgtgcctggggggccgctctacgacgggctgcaggcgggggctgcggaccatgtgcgtctcctggtgccactggtgctggagccgggcctgtggagcctggtgccgggcgtggacactgtggcgagggaccctcgctgctgggccgtgcgcaggacgcagcttgagttctgcccccgtgggagcagcccctgggaccgcttcctggtcgggggctacctctcctcccgcgtcctgctggagctactccgcaaggcgctggctgcttctgtcaactggccggccattggcagccttctcgggtgcctgatccggcccagcatggcctcggaggagctgctgctcgaggtgcagcacgaacgcctggagctcactgtggctgtgcttgtggcagtccctggggtcgatgctgacgaccgcctcctcttggcctggcccctggaggggctggcggggaacctctggctgcaggacctgtatccagtggaggctgctaggctgcgagccctggacgaccatgacgctgggactcgccggcggctgctgctgctgctgtgtgctgtctgccgtggttgctcggctctggggcagctaggccggggtcacctgacccaggtggtcctgcgtctgggggaggacaacgtggattggacggaggaggccttgggtgagcgcttcctgcaagccctggagctgctcatcggcagcctggagcaggccagcctgccctgccacttcaaccccagcgtgaacctcttcagcagcttgcgtgaggaggagattgacgacattggctatgcgctatacagtggcctacaggagcccgaggggctgctctaggtgggtggaaacgggtggttgccatgttttctaatgctggggagctgcacccacctcccttccagggatttgaatagtggtttttctctagctttttgccagaacaaaggagggtacattacttaaacccagggcatcaggatgtgcttgggctatggtggccataaaccctgagcccagagagcttgggtcactgtcacctgagtgcagctgggctgcctcaggcagcttggagtgccagccattcctgcaagcaccgtttcagctcttggggccaaccccaggacctttggctctgtccatcaccagcaaccaatccaccaacagaatgtggtttctgccatcctgggcagaagctgaaggccagcttcacatttctgctgagagaaggtgacttaacgccttttccggccctagctccaggcgttttgaggcgtctggtgcctgatggtaggtatggtgtgtttgttctgtcccccaggggctggagtcacctggtgcccctgaaggacagatttttggctgttaaaggatggcattttcctgctgtcttctgtgcgtttagttttcttgctgagcgggagctcagtatgacttgccacccacctgatacctcagggcaaggccctttttccctccagccaggtgagtgttttcttcaggcagctgagggtcctgggggagctgaggctctgtgctgcacccccagcccacagctggggcatctcactggagctgttccaggccccactggagagcagaggacctgatcccccactagagaggtccggtgtgcacagccggcctcccagtgtgccaaaatgaactgctctcagctgatggctgtattctgactttgaagcctgttaagaggtagcaagggggctagaggagggagattccacctcccctcccaagtgaccctcctcctgcctctggtatccttccttttgaaacgaagctcagcttcgaagatgtgaacaagaataaaaggaaaaaattctaatgtatatat

SEQ ID NO: 30784 - DNA, 2543 bp, Homo sapiens
ggcctgcttgtctgcgtgctgcgaagtccgcggctgcccccggggccctagtcgttgggttccagggtccttcacgttccattcccaggctggtctgagctccggggccgtggtcccgctgcctcctccggtcgtcgtgcggaagctgcgacgcaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccagaagggcctgcagaaactgatcctgaggtgacaccacagctcagctccccagcaccgctgtgtctgacactgcaggagaggctgctggccttcgagcgggaccgtgtgaccatcccagcagcccaggtggctttggccaaacagctggctggcgacatcgccctggagctgcaggcctactttcggagcaagttcccggaactgccctttggggcattcgtgcctggggggccgctctacgacgggctgcaggcgggggctgcggaccatgtgcgtctcctggtgccactggtgctggagccgggcctgtggagcctggtgccgggcgtggacactgtggcgagggaccctcgctgctgggccgtgcgcaggacgcagcttgagttctgcccccgtgggagcagcccctgggaccgcttcctggtcgggggctacctctcctcccgcgtcctgctggagctactccgcaaggcgctggctgcttctgtcaactggccggccattggcagccttctcgggtgcctgatccggcccagcatggcctcggaggagctgctgctcgaggtgcagcacgaacgcctggagctcactgtggctgtgcttgtggcagtccctggggtcgatgctgacgaccgcctcctcttggcctggcccctggaggggctggcggggaacctctggctgcaggacctgtatccagtggaggctgctaggctgcgagccctggacgaccatgacgctgggactcgccggcggctgctgctgctgctgtgtgctgtctgccgtggttgctcggctctggggcagctaggccggggtcacctgacccaggtggtcctgcgtctgggggaggacaacgtggattggacggaggaggccttgggtgagcgcttcctgcaagccctggagctgctcatcggcagcctggagcaggccagcctgccctgccacttcaaccccagcgtgaacctcttcagcagcttgcgtgaggaggagattgacgacattggctatgcgctatacagtggcctacaggagcccgaggggctgctctaggtgggtggaaacgggtggttgccatgttttctaatgctggggagctgcacccacctcccttccagggatttgaatagtggtttttctctagctttttgccagaacaaaggagggtacattacttaaacccagggcatcaggatgtgcttgggctatggtggccataaaccctgagcccagagagcttgggtcactgtcacctgagtgcagctgggctgcctcaggcagcttggagtgccagccattcctgcaagcaccgtttcagctcttggggccaaccccaggacctttggctctgtccatcaccagcaaccaatccaccaacagaatgtggtttctgccatcctgggcagaagctgaaggccagcttcacatttctgctgagagaaggtgacttaacgccttttccggccctagctccaggcgttttgaggcgtctggtgcctgatggtaggtatggtgtgtttgttctgtcccccaggggctggagtcacctggtgcccctgaaggacagatttttggctgttaaaggatggcattttcctgctgtcttctgtgcgtttagttttcttgctgagcgggagctcagtatgacttgccacccacctgatacctcagggcaaggccctttttccctccagccaggtgagtgttttcttcaggcagctgagggtcctgggggagctgaggctctgtgctgcacccccagcccacagctggggcatctcactggagctgttccaggccccactggagagcagaggacctgatcccccactagagaggtccggtgtgcacagccggcctcccagtgtgccaaaatgaactgctctcagctgatggctgtattctgactttgaagcctgttaagaggtagcaagggggctagaggagggagattccacctcccctcccaagtgaccctcctcctgcctctggtatccttccttttgaaacgaagctcagcttcgaagatgtgaacaagaataaaaggaaaaaattctaatgtatatat

SEQ ID NO: 30785 - DNA, 2768 bp, Homo sapiens
ggcctgcttgtctgcgtgctgcgaagtccgcggctgcccccggggccctagtcgttgggttccagggtccttcacgttccattcccaggctggtctgagctccggggccgtggtcccgctgcctcctccggtcgtcgtgcggaagctgcgacgcaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccagaagggcctgcagaaactgatcctgaggtgacaccacagctcagctccccagcaccgctgtgtctgacactgcaggagaggctgctggccttcgagcgggaccgtgtgaccatcccagcagcccaggtggctttggccaaacagctggctggcgacatcgccctggagctgcaggcctactttcggagcaagttcccggaactgccctttggggcattcgtgcctggggggccgctctacgacgggctgcaggcgggggctgcggaccatgtgcgtctcctggtgccactggtgctggagccgggcctgtggagcctggtgccgggcgtggacactgtggcgagggaccctcgctgctgggccgtgcgcaggacgcagcttgagttctgcccccgtgggagcagcccctgggaccgcttcctggtcgggggctacctctcctcccgcgtcctgctggagctactccgcaaggcgctggctgcttctgtcaactggccggccattggcagccttctcgggtgcctgatccggcccagcatggcctcggaggagctgctgctcgaggtgcagcacgaacgcctggagctcactgtggctgtgcttgtggcagtccctggggtcgatgctgacgaccgcctcctcttggcctggcccctggaggggctggcggggaacctctggctgcaggacctgtatccagtggaggctgctaggctgcgagccctggacgaccatgacgctgggactcgccggcggctgctgctgctgctgtgtgctgtctgccgtggttgctcggctctggggcagctaggccggggtcacctgacccaggtggtcctgcgtctgggggaggacaacgtggattggacggaggaggccttgggtgagcgcttcctgcaagccctggagctgctcatcggcagcctggagcaggccagcctgccctgccacttcaaccccagcgtgaacctcttcagcagcttgcgtgaggaggagattgacgacattggctatgcgctatacagtggcctacaggagcccgaggggctgctctaggtgggtggaaacgggtggttgccatgttttctaatgctggggagctgcacccacctcccttccagggatttgaatagtggtttttctctagctttttgccagaacaaaggagggtacattacttaaacccagggcatcaggatgtgcttgggctatggtggccataaaccctgagcccagagagcttgggtcactgtcacctgagtgcagctgggctgcctcaggcagcttggagtgccagccattcctgcaagcaccgtttcagctcttggggccaaccccaggacctttggctctgtccatcaccagcaaccaatccaccaacagaatgtggtttctgccatcctgggcagaagctgaaggccagcttcacatttctgctgagagaaggtgacttaacgccttttccggccctagctccaggcgttttgaggcgtctggtgcctgatggtaggtatggtgtgtttgttctgtcccccaggggctggagtcacctggtgcccctgaaggacagatttttggctgttaaaggatggcattttcctgctgtcttctgtgcgtttagttttcttgctgagcgggagctcagtatgacttgccacccacctgatacctcagggcaaggccctttttccctccagccaggtgagtgttttcttcaggcagctgagggtcctgggggagctgaggctctgtgctgcacccccagcccacagctggggcatctcactggagctgttccaggccccactggagagcagaggacctgatcccccactagagaggtccggtgtgcacagccggcctcccagtgtgccaaaatgaactgctctcagctgatggctgtattctgactttgaagcctgttaagaggtagcaagggggctagaggagggagattccacctcccctcccaagtgaccctcctcctgcctctggtatccttccttttgaaacgaagctcagcttcgaagatgtgaacaagaataaaaggaaaaaattctaatgtatatataactcaggctggataagggagtcttggtgctttcatacgcagctgttgagggttttctgtaagtcctgtggcttgtcctggcactttggcaagagtgcttgaggtcaattggaggtggtagagtttactttaaaaagtagcatcttggccgggtgtggtggctcgcatctgtaatcccagcacatcgggaggccgaggcgggcggatcacgaggtcaagagatcg

SEQ ID NO: 30786 - DNA, 337 bp, Homo sapiens
atttaatgggggtggtgtttctttgccctgttcctggagcaaggtggtagcgttgtgatggtggggagctttagatggggaaactgaggtccagaggggcgtgacatacctacctactctgcatgaagctgttgtcgccagggtgttggactctggggcaatgagaactcgtcaccaagagctcactatatgtgaggatctgaactgagtgccttctcaggtgccactgcaggtgagaaaagtgaggccctgggacatcacacagctagttctcggtggcgttttcttaactaatcacaggctgttccgacatgttccccgccccttcactctgcag

SEQ ID NO: 30787 - DNA, 313 bp, Homo sapiens
tgataaaatccaatttattatttcttatgtgttctcctttttatgtcttatccaaaaaaatcttttgtaacccagagtcacaaagactttcttttatatgtttatcttatttatcatatgctttgctttgtattagaacaggatcctgtgcccagatgcattttctcctcttttcaccaaggcagatggtttttgcttttattcttctctcggaagcaaatttacatttgccatgtgacatcagcctgctaatgaacttaagaaagtttatgattttttagatctggattttttttttcatttttaaagtggg

SEQ ID NO: 30788 - DNA, 460 bp, Homo sapiens
gtcgactcagtactgtgctccctagagtaggcacggcatcagtttcaaacttcaacattattttccagatttggaggctcaaaatatttgagcaagttaagttaagaaatagcctttttctgattattaggcctttcatatacaactcaaaattagtttaagagtaaagcatggggtgggtgcggtggcttatgcttgtaagcccagaactttgggaggcggaggtgggaggatcacttgaggtgaggagttcgagaccagcctggccaacgtggtgaaaccccactgctactaaaaatacacaagattagccagatgtggtggcaggcacctgtaatcccagctacttgggaggctaaggcaggagaatcgctggaacctgggaggcagaggttgcagtgagctgagattgtaccactgcactgcagcctgggcaacaagaacgaaaccccgtctcaaa

SEQ ID NO: 30789 - DNA, 646 bp, Homo sapiens
gaaaactttaattccccctcccccagtctgtatcctttttccctccacactttaatgtcctgactaggacatctaatagaatacttactttatgttgggtctctggaggtcattttgttatttttgaatctcaagtgtccattatctgtcttttcatatgtgaactactttataccagcaactaaattaagtaatttgtataagacatactgcttgtaagtaaaaaggaactaacaagccactgtgttgtaaaaatcaagtttgttgattcagtgttggcaattcaataacagtaagttaaacccaataaccaagttgggcaattactattctctgtcatgtatttacaaaaacattgtcagtttatcataatgtggctgttccgttcccagttttggtgtcaataaataacttaaatagaagtttttaaatgttgatttaaaaagaagcaaataaaatagccaaaatagaaaagtcaaaataggaaaatcttaaatgtgttcaatatactaatgatcttttatttcttccttaggttaatgccttagataagaaaacgtgtatcattgttcattagttattatagaataatagttacatcaacttacatatcaattgtgtttataaacaagtaaatatttttacc

SEQ ID NO: 30790 - DNA, 472 bp, Homo sapiens
atgtggtttatagttaatattcaaaaattagaaaatgcctgcaaaaattatgagataatgctaacaaacctaacatttggactccctagcaagattaacaacactacacgaactgatatgtcaaaattgctaatttaaggacttattttcttccaaatgtgttatttcttgaaacaccgttcataggatttgtataaagtatacgatgcatatgaacttatagacatttattttatttataagaatgactcacccttagtcacagagaagatcacaaacaagctcttataacacggttagttggttttctattactacataacaaattaccacaaatttagcagctttaaacaacacaaacatattatttcatgtttctgtaggtcaagatccacagggccaaaatctaaaagtgtcagctgagactgcagttctcactgggagcttggggtcctctccaagttcactggat

SEQ ID NO: 30791 - DNA, 504 bp, Homo sapiens
gccgacccagtcccgaggtggaccccgcaatggagggggtgggggggtcgaccggagacggtggcattgatgaggggggaccctggcccggagataggagcctgcctttagagtctaggccgggtgactgcagacaagccgctttccttctgagcattctatttcccatatggcagtaggagtgaattagatcaggtggcgggggtgagggactggtatttcgtgctcgagaatctgatatttttcaggcaaggggttcatttccttcatcaaacaccttcctcaaactttgagtcccactgagttccgagagtccatatggcatagctaagaagagaaatctggagttaggcttggattgctccgtgacccaggacaagtgacttcacctgcagagcctgagttcctcactagtaaaatgggggtaataatatgtcgtacttagctcataagcagggattgattgggatcattcaaataaacgtacttaacacagtacccggc

SEQ ID NO: 30792 - DNA, 249 bp, Homo sapiens
ccaggaagatgctggagacatactcatccctattccttctgctaagtccaactaaaaacactggacattacgtttaaaacaaacataaaagattctgaaaggtaagaactagaaagtagaccaagctaggaacctcaagacccaaagaatgacacagcaggaactccctgaattttgtttgtgcctcatacattccagagttagagctgaagaagctggcaacctggaaagagctaacgcacacaaagg

SEQ ID NO: 30793 - DNA, 302 bp, Homo sapiens
tatatctttttgttattgatttcctaactcatacttgaaacctattacagatttggaagttactccaaggttaacatcagttgtattctattctgtattttatatacgtatacctttatcaagttataaatgtgtgtgtttgttcagtatgtggtcttaatgtcaatttatttttaaaatttttttagagacagccgggcgcggtggctcacgcctgtaatcccagcactttgggaggccgaggcgggcggatcacaaggtcaggagattgagaccatcctggctaacacggtgaaacccca

SEQ ID NO: 30794 - DNA, 448 bp, Homo sapiens
catgccaaccgtcacccttctaaacctttttttcatccctgagaactgcagagcttggtctttgtgcagccttcggattaactgtgcacagtggcttttccatgttttccctgtttgccttttctggcaggcatggatgtgtaagctgtgccagcatttggcctgtagtacatgtcctaaatagttatttacacagtttgagtccattttagtcaactgggtaaataacagccctcttcaaaagatttataaatccataaatatgtctttatacatacccaatagacagaaataactcaatctgtcaagaacatatccaaagaggtgtttcccccacagacaggagtaatacatattttaaaactttctctgacatattatttttactgcatttcttttttcctcattccttttccatttttaccacttcattatggcacctgtggtt

SEQ ID NO: 30795 - DNA, 680 bp, Homo sapiens
ttccttaatgtcaaatgatgttggacattttttgatgtgcctccctgccatttctatatctttttttgtgaaatgtctggttaaatctcttacctagggtttgttttttttaattgagtttttaaagtgctttctgtattctttatcagatacatgctttgcaaatttttttcagatgtcttgacttttcatttgtctcatggtgtctttcaaagagccatttttaatttttgaattttaaagttcttatcaattgttcttttatgaatcatgcttttggttcatatctaggaaatctttgcctaatccaaagtcataaagattttctgctatgttttcttctagaagttttattattttactttttacatttaggtctatgatccatttttagttgatcttgtatctggtatgaggtatggactgaagttttatttatttgtacttggataaccaattgctttcagcaccatttgttgaaaagactatatattctgaatttcattgcctttatatcttcgtcagtatgtttatatctttgtccatttgtttgtaggtctatttctggactctgttgtattctgtatatctgtttatctttccaaatgccaatactacagtgtcttgattactgttgctcaaataaggttgtgatagccctgcaactttgttctcttttt

SEQ ID NO: 30796 - DNA, 1744 bp, Homo sapiens
gccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctca

SEQ ID NO: 30797 - DNA, 614 bp, Homo sapiens
ctcggtacccggtccgctcggaccaagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgagcggaccggtccgctcggaccatctggacccaaaataattggcatatcgcccgtaaaatcaattgcgccaatggcataagcattgtcgtgaatattggaaggatgtaagcctgcctcaccaccgtcttcacgtgcccactcaggtttcggcccaattaaacgaatacctgtccggcttgagttatagtgaatttcaaactcattggcaaagaacgtatcaatatcttgtttggtgaaaaaatctggtgcgccatgtggcccatacatgacggcaatttcccagttttgggtaaagctaggaatttgccttgagctaaagctgtggtcgtccgagcga

SEQ ID NO: 30798 - DNA, 1438 bp, Homo sapiens
gccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctca

SEQ ID NO: 30799 - DNA, 2104 bp, Homo sapiens
gccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctcaaaaaaaaaaaaaaaaaaaaaaaaaaacacaacaaccacaaaaaaaaagagggggggggggcaaagataccggggggggaacactatactgccccttctttggaaaaggccccaagggagtataaaaaagggccggcgcgggaacacacgggagaaaacgtccgtgtgtttggagcaccttgcgcgggtcgtggaccaccaggatagcccgataaattattgttgtggaactgttttggtgttgttgttattcacatctatagtacaataacaactaagatacaacagtccatgaccataagtagcatactattctcctgtctactcctatctactcctcaacacgaccgacacagaaacg

SEQ ID NO: 30800 - DNA, 1767 bp, Homo sapiens
gccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctcaaaaaaaagcaaaagcacacaaca

SEQ ID NO: 30801 - DNA, 829 bp, Homo sapiens
tgatgctgaggtgatctagaggatcccgaggagatatcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctca

SEQ ID NO: 30802 - DNA, 534 bp, Homo sapiens
aaatgtgctggggtgactctagccggatccctgactaaatggctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctca

SEQ ID NO: 30803 - DNA, 353 bp, Homo sapiens
cgggattcggcgccggacagaatgcggagaggatgtgtcgctaaaaggacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctca

SEQ ID NO: 30804 - DNA, 216 bp, Homo sapiens
gcaaaccatttgcacagtcataacatctatacaagtatttgcttattaccttggccagaaaaatctcttttcaaggctgcttcacagggtttcttgagtatgcatgagtcaacacacatgttcatagaggagaagattgtgctgatttgctctacaccaacgttctgttaaaggtggaaccaagtcacttctgtcactgatcagagcaccgcttat

SEQ ID NO: 30805 - DNA, 383 bp, Homo sapiens
gtggttatgattctgctaatgataatgtttgtctcttgcttatggatagccttagcctggtggagatgacaatattctctggcctatgcaagaaaagaggagggaatcccacttaacgaaaacttaagtcattctcaaatttattcaaatcatacttgaaaaggcggaatgaaatttagggggatatgttttaactatataagcctttgctaataaaagattaagaagtatgtggcttagcatcttttaattatttttttctagcaacttgaatatacaatgtttgaaaactctggttggatcaacattattttgctcagaggtttgtggactttgcatactgattctttcctgtttccaagtacatttgcttttaggctatt

SEQ ID NO: 30806 - DNA, 343 bp, Homo sapiens
tgagacggagtctcaccctgtcgcctgcgccagagtgcagtggcgcgatctcggcttgctgcaagctctccctcccgtgttcaggccattctcctgcctctcgagtaactgggactacaggccccctccaccacgctcggctaattttttggatttttagtagagacggggtttcaccatgttagccccgatgatcttgatctcctgacctcatgatgcgcctgccttggcctcccaaagtactgggattacaggtgtgagtcaccgtgcctggcctacttggggaactttttataaatgcaacttccaatccagattccctcttcaccaagtgtctcaagta

SEQ ID NO: 30807 - DNA, 648 bp, Homo sapiens
aacacaaaacactttagttacatttcaaatattttataaatagtatacagataagttagaattgaaagaattaaaaaaagctaattacaaaatagaaaacatatctaagcaaggcttatagctgagatagaataaagttgcaagacagaaccatccatttttggataaggtggtcagaatgagagagaaaacaataacaaagtcagatgtcttcttaactgtgaaaaatatatgtaaaaaatgagcattcataaacttagatttaaggtatggttagatcaggcttattctccttcaggaaaagcaaagtacagatatgcctattagtttaagaattaagatttttaaaaagcaatgggaggctggtcacagtggctcatgtctataatcccagcactttgggagaccaaggcaggtagactacttgtgccccggaggttgagaccagcctgggcaacatggcaaaatcccatctctacaaaaaaaatacaaatattggctgggtgtgctggcacacgcttttagttccggctacttgggaggctgaggcgggaggatcacttgattccaggaggtggaggctgcagtgagctataattgtgcctctgcactctagcctgggcaatagtgtgagaccctgtctcaaaa

SEQ ID NO: 30808 - DNA, 287 bp, Homo sapiens
tccctttggccctggacagattcaggcagagccttgactcctccatttgtgtggtcaaaaccaaggacgtcagatgggaacctcaagcttgtgggttccaccttgtcatttcacagttggggccatgaggtccagagacggggaatgccttgcttaggttgatgccctgagtcagagatagggcagagaccaggactcctgtgtcccggggaaatgtttactctgcgcgccagtggtggtgggcttggcgttagatctactgtcttgttctctattttctgttcatg

SEQ ID NO: 30809 - DNA, 374 bp, Homo sapiens
taagggtgtcaatttgacctgggggttctgaaagtctcaggaaaggcagatgggggagggcccgaggcatccacagctttgagtgtcctggtgtctaagcaggagccatggagaaggtgggaggtgtgagttaggatcagctggagatcggtgctcttttgtccaagagaatgaagttgtcttcaggtatgatttggtttggaaacaagataaaagagattggccgggcacggtggctcaggcccgtaatctgagtactttgggagaccaaggtgggtggatcacgaggtcaagagatcgagaccattctggccaacatggtgaaaccccgtctctactaaaagtacaaaaattagctgagcatggtggcgcat

SEQ ID NO: 30810 - DNA, 1179 bp, Homo sapiens
ttgtacctagatttatgaaaaatatgtagtgctgttttgtaaatttacttatatggtatattgcatatatgcagcttgctttctactaggcatttttactgatttatctatgttgatatatgtttagtagtctgtttttgactgctgtacagtattccatcaaacaaccttttttttttttttggagacagggtctcatggtcacacaggctggagggcagtggtgtgatcatggctcactgcagcctcaacctccgtggctcaagcaatcctcccactgcagactccccaataactgcgactacaggtgtgtggcaccacacccagctaatttttttaattttttgtagagacgaggtctcactatgttgcccaggctggtcttaaactcctgagctcaggtgatcctcctgcctcagcctccccaagtgctgggattacaggtgtgagccactgctcctggccatgaatcagccatagataaattagacatttcccctagtgataaattgctaagtcattacttttttccattataaccatgccatactgaagatctttatacatgtctaatggtgtgaccatttcttcagggcatatacctataagtgaattggagctaatacacttttcatattgttaggtattgacagtggctgtaccaactcccacattagtggagtagtttgtgagaatttgtttcccacatcttttcaacatttgctgttagatttcctaattgttgctagtctgatgggggatagtagtaccttgttttgatttgcattttcctgacgtttaccattttttcagtttattggttattcaggtgttttcatctgtgacttcttatgttctttcctatttttctcttgggtttttaaagaaatatccagtatcgcttatatacatgaatactagtctgtatttaacgccttagatgacacttagaaacctagcctgcttttcccttgagtttactattttagtcagcactcccatactctagtgctaaccaatcaaaaacattttagtttagcctgttattttctctgtatattaattcatgctgtttcaagataaatctgattttcttgggctgaatttatcatgaaactgactctaacagccattggtttattcattttccaaatatttattattgaagtacagcattaa

SEQ ID NO: 30811 - DNA, 673 bp, Homo sapiens
gaggccaggattaccctaataacaaaaatggacaaagacattataagaaaagaaaattacataccaattatctcttacaaacgtggatgtaaaaatcctcaacaaaatattagcaaattcaatccaacaatgtataaaaagaagtatacactatgatcaaatgggatttacctcaggtatgcaatgctggttcaacattccaaaatcagttaatgtaatccatcacatcaatgggctaaaaaaaaaaaaaaatcccagccaggcatggtggctcacatctataatcccagcaattcaggaagccaatgcaggaggatcacttgaacccaggagttggagacaagcttgggcaacatagtgaaaccctgtctctgtatttttttttaaatcacatgatcatatcaatagatatgattctgttgagtggatcaagaaaaagcatttgacaaaatccaacacccattcatgataaaaaattctcagtaaactagaaatacaggggaatttcctcaacatgataaagaatatctacaaaaaatctactgctaacatcttaatggtgagaaatgcaaagcttttccactaagatcaggaagaaagcaaggatttcccctgttatagtttttcaacatcatactggaagtcctaaataatgcaataagacaaaaaaaaa

SEQ ID NO: 30812 - DNA, 961 bp, Homo sapiens
ttgagatccactaactcccctcccaagcctgcaggtaaaaccatcccagatcacctttattcctgctttagggtttaaaaaccccaggaggcaaacaaattaaagactgcagatgttcttaggatggttagacttgacacagaagagaaagaggtacaactgttcatagagttcagtttgacaattaacatgtatattagtatggttgcctgtgtttgtgttatgtttcactgtgtttcatcttcctgtgcctgggatcccccatgccctcctttcctatctttctcaaaaccagctgtttttccccatctgctgcattttggttatagatatttatttgtaggtttgctttaaaacaaaactcctctaaatcctacttgataaccatccatgctctttactctctcctgtcctgggagctctcttcctaactcctgcccttcattctcgacgcctgcctggcctccttttggttccttctctacagcattgcttccacccaccagctgtagtgcccctgtcccttaagagtatggcagtgcctcctaactgggttatatacctctgattgtccatttttaaatctgctaccaagagctttttaagctgtggatacgattatttcatcgtgggctttaaaaattgtgaggaggggcccttcagtgggtttccagagcaacaggataaagttcatggctcttagatggaaccttgagcccagcatcattctgccagccgcatctttgccatttcccccactgcactctccctcctttctcaaaacacactggtgcactctgatagctcccaggggttttgttttcatggacaagacacacaaaacttttgcagttagacacaaggttgccgtttttttattttgctaagtaagggcattaaaaaatgatctctaccatctactgtctttatctcattttaaaagatggcagtttaccctaaa

SEQ ID NO: 30813 - DNA, 382 bp, Homo sapiens
aattatcttatagaaaatgtatattttttaggatatcatctctattccttctatgttaatgaatcatgctctttagcattgatgaaagtttcaattttgagaatagtagaccttgtcaggtgtcactttgagtgccagcaaacggttgatttgaggcaagaagaataaagtttaaaaaagaaaataaatctagcatttgcttaataatttgccctttgcagcaccagaatcttatgtgaccacccacattcatctggttactgacgtggttcttgcttcaattgcagaagctatttttgcaccttttgtgtcttttgaggaaccgagtgggcctacttgcttattaatgattcatgtctcaagtggcacagggtgtcctgaa

SEQ ID NO: 30814 - DNA, 966 bp, Homo sapiens
  misc_feature (69)..(69): n is a, c, g, or t
  misc_feature (207)..(207): n is a, c, g, or t
atgggggaatggaccatcttggagaggctgctagaagccgcggtgcagcagcactccactatgatcggnaggatcctgttgactgtggtggtgatcttccggatcctcattgtggccattgtgggggagacggtgtacgatgatgagcagaccatgtttgtgtgcaacaccctgcagcccggctgtaaccaggcctgctatgaccgngccttccccatctcccacatacgttactgggtcttccagatcataatggtgtgtacccccagtctttgcttcatcacctactctgtgcaccagtccgccaagcagcgagaacgccgctactctacagtcttcctagccctggacagagacccccctgagtccataggaggtcctggaggaactgggggtgggggcagtggtgggggcaaacgagaagataagaagttgcaaaatgctattgtgaatggggtgctgcagaacacagagaacaccagtaaggagacagagccagattgtttagaggttaaggagctgactccacacccatcaggtctacgcactgcatcaaaatccaagctcagaaggcaggaaggcatctcccgcttctacattatccaagtggtgttccgaaatgccctggaaattgggttcctggttggccaatattttctctatggctttagtgtcccagggttgtatgagtgtaaccgctacccctgcatcaaggaggtggaatgttatgtgtcccggccaactgagaagactgtctttctagtgttcatgtttgctgtaagtggcatctgtgttgtgctcaacctggctgaactcaaccacctgggatggcgcaagatcaagctggctgtgcgaggggctcaggccaagagaaagtcaatctatgagattcgtaacaaggacctgccaagggtcagtgttcccaattttggcaggactcagtccagtgactctgcctatgtgtga

SEQ ID NO: 30815 - DNA, 237 bp, Homo sapiens
cagctacatgcttcaccactagatggtgctcctgcctcagccatctaaagtgctgaatcagtgatgtggaaaccaacaaatgtgctgatgaagtgtggccactgaataaggagatttaggctatggaaaaatggaatacaaatacattgtcttatagtattagataagtaggttagcacaggctaaaaataggaaatgcctaacagtcaaactgtttgcagattttaaaaattcaaa

SEQ ID NO: 30816 - DNA, 217 bp, Homo sapiens
aaatgtatgaaggggtatgtgtttataaacacatatacatgtgtaattatatgggtactcacataaatttgaagagtctatctataaaattttatatatgctttatttttattttttatttgtatgttttatatttttatttctagcatgtatttttatttttatgtacacttataactgtataatttaattgccaaaaattatgttaaatgggtat

SEQ ID NO: 30817 - DNA, 437 bp, Homo sapiens
gaagctaccctgcctccactagatagagcagggagagttctgtgatccccaataggtaaggactatgccccaagccagcatgaagcagttaccaaaaaagatcatcggtccctctgcctcccataaagatttatgggatcacatctctcagggaggagatgaggcaggaaaatacggtctggaggcaggaaacataaggacaattcacacttcagctatgacaggaaatatcctctccatagggcataggccaagtaaatgactttgcaactttacttcatcctcttcatttatgtagtatgtgtcccaatcctctagaggatattgaaactcccaaaattctaaatagtgtggacttggagcccctatgctcaggcccgctcccacactatggagtgtactttcctttacaataaaaccctccatttcttccttgc

SEQ ID NO: 30818 - DNA, 214 bp, Homo sapiens
tcttcagccaactgaacaatccataagtgtttattcgttaaaagctcactatgtacctagcactgtaaatagaaaaatagcaacatctctatatcaaaatacgtaggagtggaaattacttagtggagatatgttgatgtaatttttttaatttttaaaaacaaaactcttattccttggccaattaaatgcatttcctgcagtatctatttaa

SEQ ID NO: 30819 - DNA, 461 bp, Homo sapiens
aaaccctataattgtaaacctaactttgttgaattatatacacatacatataaccctcgaaaccctgaaattcatttagaattcttaatatcctagaccatatgctaaattctcaaacctgaaatttctcaagttataccaatcatttcactaattattcagtaccattcactagtgtgcatcattatgaggaaaagctgctacttgttgttatttcattacccaaatacacaatccccactaagagttcttgtcttggccaggcgcggtggctcacgtctgtaatcccagcactttgggaggcagaggcgggcagatcacgaggtcaggagatcgagaccatcctggctaacacagtgaaaccctgtctctactaaaaatacaaaaagaattagccagacattgtggcgggcgcgtgtagtcgcagctacttgggaggctgaggcaggagaatggcatga

SEQ ID NO: 30820 - DNA, 515 bp, Homo sapiens
gaccatactccttgaattcatgaagcttacagtctagttgagagataggcagtaaaattgaaaattagatggtatatttaccatataatatagggaaaaaataaagcaagtagaaagatggggggggccaaggactggagggatggttatgattttaaatagagacgtttaggaaatctataccagaaggctctactgaatcagactcaatagtagtaaaggaatcaggaacagtgactcagcctgtaatcccaacattttgggaggctaaggcaggagatcacttgaggccagaagtttgagaccagcttgtttgtgacagggtctcctatggagacccgctctctacaaaaatttaaaaattagccggacgttgtgatgcaagcctgtggtgccagctactcaggaggctgaggcaggaggatcacttgggcccaggtaatcaaggctgcaagtgagctgtgccactctagcctgggttacaaagcaaaaccctatccccctaaaaaaaaaaa

SEQ ID NO: 30821 - DNA, 967 bp, Homo sapiens
gcggaggttgcagttagctgagattgtgccattgcactgcagcctgggtgacaagagcgaaactccatctcacacacacacacacacaaaatgtaaagccatgaggatgaataatagtgttctcccaccacccttaactctagtgctttgaaaagaagactcgaatcacaattatttagtaacattctccctttcaggtgacatcatcatcattattatcatcatctacatttacatctgtcttattaaatgatttatttctgaaatatttacatacataatttgggtaatgtctatgtaatttccaagagatatcattgtgggaaagttacattagtaaacagcaaagttcatgtcaggctgaatacattgagatttagaaagttaagtgtagtgtagtgtagtttaaaatacattgcttaagaaaacaattatagatgatattaaactaatccaaggaacactataaaaagattttgattttagtataaataaaattgcttagtaagaaaaataaataaaccatttcatgatcaagctcttatttctaaagagaggattttagggctaaataaatcaaacagaagtaagctctcccccacatcttgtctatatcatttggataatgatgtaattcaaaggcacagagcaccttttcaacaacataagcaaagtgaaaattatgtcatggaatacaatgatgtatctgtggttaatgaactatattttatctattgcaatgatattttgaaatccagtgctgctctttgagttccctttgagcagagtttgtggtggggacccagcaacagacaagctaatatccaaaaaaagctactcacatcaacttaatttccagtttctttcaaattgaaggtaaattctaacacaaagcttttattctattctctgactaaagtgttgggaaaagaagaaaattgttaccgttttcatttctaacatacta

SEQ ID NO: 30822 - DNA, 393 bp, Homo sapiens
gcgggtgactgtaatcccagctacttgggaggctgacacaggagaatcccttgaacccgggaggcaaagtttgcagtgagtcaagatcgcgccactgcactccagcctgggcgacagagcaagacttggtgtcaaaaaagaagaaaatttctccatgtagttgtatatcatttttttctctatgtattttgagtctattttataagttatatccagggtttaaagttgcagtgaataattatcctgggtcgttttaaattgcagtgaatcaaaggcatttaggcattacataatgactattcctgggtgatgctttttctcttggatattgttttgtctaatatttaatattccctttgcccatttttcttttggcttaggtaatgtaaggca

SEQ ID NO: 30823 - DNA, 155 bp, Homo sapiens
gttctttttccctgtgctggcaggactgctctgagagagcagccaagaggaactggagctaagtgggagctcccttttaggatcctcagccaagacaaatgactgtcacctgaggcattagtgtgcatgacttcttccaggcccctttgtcgatg

SEQ ID NO: 30824 - DNA, 389 bp, Homo sapiens
tcctagtgccaagtgtgcctgccttcctcattagctcagtgacataaggaatgggttttcagcaccaattttttttaactggtatgtagaagaatctaaaagtttattttttattttttaatattttatttttccataagttgttggggtacaggtggtatttggttacatgaataagttatttagtggtgatttgtgagatcctggtgcacccatcacctgagcagtatacactgcactgtatttgttgtctcttttccctcgttcccctcccactcttccccccaagtccccaaagtccatagtatcattcttatgcctttgcaccctcatagcttagctcccacatatcagtgagaacataggatgttcggttttccattcctgag

SEQ ID NO: 30825 - DNA, 454 bp, Homo sapiens
atctgtttcaattctagtcactagcagccccacctacataatgtttccagtcctgttcttttttttttttttacacatttttgccttttcttttggttttgtgtctgtacatctcagctattgacacattgctgtatatatatccactgattataatgcatgtgtctgtgttttcaggaagccttttgatgctgctgcataatgtgtaaatggataatgctcaaagagacaaattaccttttaataatagattgacagttatttttaagaaatgaaaaccaattttgaattgatatttgtaggcccacactgtgcctcaatgtatgaaacctcacctaaaccaggaagcctaatgacgatgcgccctttcctcttaactgtttgcagcctgcagttggcactgttcgtgatgcatggtctggttgtgccctgtgctggcatggagtcaccctta

SEQ ID NO: 30826 - DNA, 358 bp, Homo sapiens
gagagagggtgatgactgatctggggttggagaagaaagcacatgtttgagagggctgtggaagatggaatcggggagactctgccagcagaacatgtgggcaaagcgccgatgagctgttctggagcacggggcccagcacagggtgagaggcaagatgcctgtagggaaatccaggagatagttaaacacaggcaagggtctggagctcaggagaggcttggtctggaaggaaaaagttgaagttcatcacaacacaggtggtggttgtcaacactgtctagaaggagtgtacagaaagagaaaaggatggtttgaggacagagccctgaggaatgaagaggggcacgcaaaggag

SEQ ID NO: 30827 - DNA, 135 bp, Homo sapiens
taaaaattctgtataattggcttcagtgttcagagggaaaaaatgttaaggtgttcatgtgcagaccatggtctaaaatccaattctgaaaagagcacatcttataggaaatttagactcaaaatgtacattcat

SEQ ID NO: 30828 - DNA, 346 bp, Homo sapiens
atgaaatgacatgattgtggccattctgtagtctttaaaaggagatctatttgtgtcaataaacaacgagctcattaaaaactacccataaaacaattaggccaagggaattttgtctgataacagtgaaagaaggaagtgaggatttagctgcagattctggaatgagcctgtttatcctccaggaccacagcagttttgtcttcaggcttaagataaatcactgtaagtgtgaaggtgttcagaaaaataggttctgccattgctactatgtcctgaagtttcttccagtttgcctttgaagaacacagccactaaaccgccgctagatgtcctcaaagtaaaa

SEQ ID NO: 30829 - DNA, 96 bp, Homo sapiens
actgccagcatcctgctgcaactggctccaggctgagtaattgtccgccacgcacactcataattttcaaggctcttcaggactaattggctgggg

SEQ ID NO: 30830 - DNA, 595 bp, Homo sapiens
atacatgattttttttttttttttaagatagctgactctcactgagtggatatctgtgttttcactatggaagcaagagtcagcaaagaagaaccttcaatccaaatgaactgcaggaaaagatcaacccctgcttcctagccaggaacaatggactcaccctgtgaacatacaaagttctcagacttctcagctggttaacaaaagaaatttaaaatgtaaaattgaatagaatgttatagtgactaatttaatctaaatgatgcaattggaaaagttaagaataaatccaaacacacacatttgccaatttggggacataatttaactcttttccacaaaggcactgaaattcatttatgaataccaacgttttcatgattaaattatattaaattctagacctagaaggaagatagtcattttacaaaacatggttaccattaaatgaaaaatttaaagacctaatagcggtgttgtgggtgtttaaacattttctttaataagctattataaatactcatacttcatcttctacatttgagtgtgcatgtgtgtgtgtgcatgcacagacacacatattactagaggtcga

SEQ ID NO: 30831 - DNA, 433 bp, Homo sapiens
taacaacaacaaaaacttctaaccagtaatactcgattcaaaattattttacttcaaaaagaatataaaaataaagactttccaaaataaaagttgagactgttcatcaccattggcacagtcctacaagatataatatacagggttgtgctccctggctcacgcctgtaatcccaacactttgggaggccaaggtgggtggattgtctgaggtcaggagtccaagaccagcctgaataacatggtgaaacaccgtttgtactaaaagtgcaaaaattatttgggcatggtggcacattcctgttgtcccagctactgaggaggacaaggcaggagaatttcttgaatcaaggaggtggcgactgtaatgagccaaaatcatgccacggtactccagcctgtgacagagaaagactccatctcaaaaaaaaaa

SEQ ID NO: 30832 - DNA, 527 bp, Homo sapiens
agtagctgggactgtaggtgtaacccactacacccagctgtttttttattttttaagaggtggtggtcctgggagtcttgccatgttgtccaggctggtctcaaactcttgtcctcctgtctcagcctcccaaagtgctgggtttaacaggtgtgagccactgcgccctgcctgggttcatattttttaagcaacagtcatgaatgttaggtctcctggcctacttgagttacatatgaagctattgaaaactcaaaattgcctgtagtcctcctgcctcagcctccgaaagtgctggggacagaggcatgagcctggcctcaaattttaaaatgacacaaatttaggaggaataaatactcagagcattggatgatcagaacaggggctgaacgataatagctgagaatgttaggcaggaatctagctaaataaattggacaggaataaattctaccagaacaaccaatcttagtatgataggtagaaggggggaaaaaaaaaaaagtcgactctaggttaattca

SEQ ID NO: 30833 - DNA, 477 bp, Homo sapiens
gtgtgtgtgtgtgtgtgtgtatgtgtgtgtgtaaaatacagacagggtctcactgtgttgcctagactggtctcaaactcctggcctcaagtgatcctcctgtctcagcctcccaaagtgctgggtttaacaggtgtgagccactgcgccctgcctgggttcatattttttaagcaacagtcatgaatgttaggtctcctggcctacttgagttacatatgaagctattgaaaactcaaaattgcctgtagtcccagaaggctgaggcaggaagactgcttgagcccaagagttccaagctgcagtgatctttaattgtgccactgcactccagcctgggtgacagtgagatcctgtctctaaagaataataataatagataatacttgttttatcaaaatattggccaatggaagaaagtgaagtcatcgtgttgttaaaaaatactagaatactcagtagagatagcaccatgtt

SEQ ID NO: 30834 - DNA, 287 bp, Homo sapiens
taacactaaatccccactactaccaatccctaggcatagaccccagtttgccaccattttttcttaactgattatccaaagccactggtttaacttctctctaccaagccttctgttctgccacctgagagaactgttcaactatagacagtattgtagtaattatgaaaattttgatatagtgacaacacagtgatgatagtgtaacttttacagagtgcttgcatgtgccaagtactgtgctttttttttctttttttttggacgcaagaccttgttctgtctcc

SEQ ID NO: 30835 - DNA, 661 bp, Homo sapiens
aaaaaataatcatagagactcaacatagtaggttagtcatatgtgttggtctctttttctcaaagccacaccaaaataagagtaaaaggaataaaatgtaaacccacagggtcagcccacaagagaaggtagaggaggcatcagtggatgaaaaggtacaataatctgaaaggtggaaactggttggaatgttgatagccaaaatcagtgcaaagaaaatacagccaaaattcatcctgtagaacaacttcaaagacttaaggcttgcagacagcaggtagggaggaagtgaggtacaagacaggattgaaagtgaggaattggttagaagttggagcctcaggaaacttccccaccctgagcagtcagatgccaacccctagtcaaggcaggagaatggaaattttccattattctctggaaaaatggaaccatggaaattaaggccatggaaacagtgggcatggtggtgggccagggtgagatgcagggctggaaattgattaggtacaaattgcttattctgccatggtcttctgctcccctttcccttagaacaccaggaccagagcgggtgggaagggagtggaaagtttatctggtatgtttggccatttggaaaagaatattgatgggtatctgacaggtccgagaatgtgtt

SEQ ID NO: 30836 - DNA, 437 bp, Homo sapiens
agtgagtctctctgctctattttgtatcccaacccctttattgtcttagggactctatcacatcaagacaatcttttacttctcccttcctgctgccttcttttctcagcctattcccatgagcaaagctattccacatttaagaccctccccttaaccccaaatctccctctaactatggcctatctgactgtttcttttcttagaaaagttttttttttttaagagtagcctggactccagtagttccaggactgaggttcaagagaagcacaggctgctgcccctggagtttaacaccagaggtaaaagcatgaaggaggtgcaggatgccacttttaggactgagactcaagtgaggcaccatttaagagcctaacccaaaagaatgtgaaccattctggagcccagcgattctggggctaagttgcaaaaga

SEQ ID NO: 30837 - DNA, 574 bp, Homo sapiens
gctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatcccccccaagaggcgccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctataaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaa

SEQ ID NO: 30838 - DNA, 274 bp, Homo sapiens
tgctcattaagctacactgtctactgaaaacagaagcataaaaatcaccaagaagtttctcaaagatttgctcaactttttagagttcccaagcataacaactcaactgcaacaaatacaactggctgtattaatacacctatccacatgaaacattaattccatgttgtcaaagagcaagttttacaagatgactccaattctcatctcaaggggatatgagaaaatttacagttaactgagctcaacttcactcaagcttatgcctcatctt

SEQ ID NO: 30839 - DNA, 318 bp, Homo sapiens
ctcaaacaaaacaaaacaaaacaaaacaaaacaaaacaaaacaaaacaaacataagtttgcctcctttaggaggccaaggcaggatgatcacttgagaaaactggcgccaggagttcaagacatagtgagacatcatctctgcaaaaactaaaaaaaaaaaaaaaaattagccaggcgtggtggtgcatgactgtagttccagctacatggcaggctgaggttggagaatcagttgagcccaggagtttgaggctgcagtgagccctgatcgcacagctgcactctagcctgggtaacagagtgagaccctgtctgag

SEQ ID NO: 30840 - DNA, 418 bp, Homo sapiens
acccacaaaagtggtctctgagtgtcagtccagtgggacccccaccccttatggcttcagttccccaaatagggctggacccttgatcctgatccagctgtggctatccagccccttcctggggactttggactttgaggggggcatgcccagttgtgctgggaatccatactttccctggctggagtagaacctgtggactgtagtcctgagggcagtcatgttctgcctgtgcctggaaacacaagaaacttgactgcagagagaagaaagaggagagaggaacagagcgaggaaaccgcccgtctccggggctttttctgttccctatccttgactttctaagaccagtggggtcccctcctctgcttctttttcctgagttctgtgaaattccccaattcttattttttatctc

SEQ ID NO: 30841 - DNA, 633 bp, Homo sapiens
tgtggtggtgtgtgcctgtaatcccagctacttgggaggctgagacaggagaatcgcttgaatccaggaggcagaaatggtagtgagccgagatcatgctgctgcactgtccagccttggcgacagaacaagacagggtctcacactgttgcctaggctggagtatggcagcctgaaacgcttggattcaactgatccacccacctcagcctcccaagtagctgggactacaggtgcaggccaccacgcctacctaatttttaaaatttttttaatttttgtagagacaggatcttgctatgttgtccaggctggtctcaaactcccagccacaagtgatccttccacctcagcctcccgaagtgttgggattgtaggcgtgggccaacacacccagccagcttcatttctgcaccgaaccttttattttgaaatgattgaaagattcacttgcagttataaaaaataacgtggaaagatctatgtaccctttacccagtttttgccaatggtaacatcttgcaaaactatagtacaatgtaataactcggatattaacattgacactttactatttttttagatcaaaggtgtatttcatacttaatggtcaaaatgattttcaaaagatag

SEQ ID NO: 30842 - DNA, 287 bp, Homo sapiens
accttttgtctatttaaataatggtactataaacatttgtgtacaagctttgtgtgaacaggctttcaattagtattttaggagtggagttgtggggtcgtatgttaactctatgtttaacattttcaaaaaccgtcaaactgatttccaaaggaactgtaccgtttttacatatctgccagcaatatgagtttcaatttctctgtgcctttagttacaataacaatataacagcccttgctattgtcttttaaaaaaaatacagccactctaatgaatgtgaagtg

SEQ ID NO: 30843 - DNA, 371 bp, Homo sapiens
cagagatggagccacctgtcttctgcccagggtgggacaggagctggaacttgtcctgcttcttagatgtctttgaaaatcagacttcctgtctctgctgcctccacacccattgcagatgctccaggcctggcccagttcttgaccctaagtataaatgggccattccactgcccgcccacgtccgtgccctctccatgtccccatattcacctatcttctttttcctatccagtagcattttggtgcctgttctcccttttccttctccctgtccacgtggattgattccttaaacaagaacaaaaaagaagtcagggaggagggatatggagagaggggcagggaggaaaatagattgcctatattca

SEQ ID NO: 30844 - DNA, 390 bp, Homo sapiens
gatatctacctcatagaattgtcgggaagattaaccactatcccggcctcttacacttcttaatacacccacagtgagccttgcactgagcaaagtctcaatatttcgttgccagattcattacacagtccgtaggccccaggggctctgcatcatgcacaagtacagttagtactggcttttcttccttgtttatgtgaaaggtacttcttttctaataatctccactcctcctctgtcccctttccccaccagctagaatcctaaaacttaagcagctaacttctgtttcctgagagagaaagctatcccaggtagtcatccaagtcctggtaagcacagcattaggaccatggccaggcctctcaccaagtcagcagacttcaagga

SEQ ID NO: 30845 - DNA, 438 bp, Homo sapiens
tttcatcaaacatggcataatttttcagtacagctacttgagtgtgcatatttatgagtagcttgaaacaataaaaacaatgaaaaaccttttaatgcactgaaattagcacaaatatgagctatgtagctaagctccattgttcatagcattgaagatagtcacatctaattttgctgctatagaaagcaaatcagttctgctaactgaagcccacgatattttgcacattatttttttgaatttcttcggtctattttagtgtttgaaatgctaaaaacttctgtcccagcattctttctggaaaaaagtctgtatactgtcttttgagctctgctactagttcacaagtcactcttgactgaagttataaagcaagagaggggattttatttatgggattttgtattatttttttctattcactatagtgcattt

SEQ ID NO: 30846 - DNA, 354 bp, Homo sapiens
ttttccaagagcacctcattttggggaatttgtccaacgacaccaacagcctgctgggtgtcaggaaaaagccctgcatttctgattaattgcttacctgtactttatcagaaatccagagattgaagtgaccttgaaggattatgaggtctgtccctgtatccaggcaagaccgtacttaaccacccagacagatgggacaaggcatgtttatcaaaaatgccttgaagttgaaattaaaatctccttatagaaaaatatttgaaaatttttcatgaccacaaaaagtttgaaaattatgaattaaaaaagtttttattacgaaagtagtatttaaaatatcagtacagaaat

SEQ ID NO: 30847 - DNA, 1126 bp, Homo sapiens
tgttccttagcacaggtggtgtggatttaatttcttctcctggggtgacctacttgtatctagaggggagaaatattgtaatgaaatgctcgttacttacaaaccacaccaaattccaggtgtactgtaccaaatgcatggaaatgagtagaatgtgctctcccagacctgctagccaaggtgaaaatgcttccctgaaattactcatttgcaaatgcctttgaagtcattagataatacacttggcctcaaaggcaccaggcagccaaattttacgttggagctgtgtgtacccaaccgtggaatttgcctcccaaactatagcaaaactgataatgcatatcggttttaaaaagcgaattttcaccttgaatctttctcctataagaccactgggaacagaacgctaatgtatcctggcctccctccaattctgccattatagattcaccttcttaacccataatacatataattccttcttcctagtgcctgccttattgaggccatgcacacatgtgaccactcatccagcatatttgctgggagaactgaggtaccatgacttggtgctgcagttgattagcctagaaatcttaagaccattccaagagcacgattttatggccctctgattcatgctatggatatgtaacatgatttctgatctgtgggagctgccagataggcctgtcccaaataaagatcgtcacaaatctttactgaatgatattattgggaagtgcacaattatggcaccctgtaaccacctccagaactttccatggtaggcatgggcccaccccattcccttaccctgaattggttcaatactgtatctggacataacaggttacttccaaccataatctgcatcgtggatagacataaggaaaaacagctttctcaaccacctacgtaataacagcaaaccactgtttcccaaactcagtgggttaaaagactcacctgaaaagctttcaaaaatacagattttggctgggcatggtggctcacacctgtaacaccagcactttgggaggccaaagcgagaagatcacttgaggtcagaagtttgagaccagcctgggccagacagtgagatccctgtctccgccaaaaaaaa

SEQ ID NO: 30848 - DNA, 270 bp, Homo sapiens
tcagtgctctccatgcctagagggtcccctctacctgagactgcaggagacagaagcctctccagggacaggtccttacctgtgtctcctgcttcttcccaccgctgtccagcccttgaagctgatgctccctggacacaatgaatcaggggccagcagtgataaaacacacaaaaatcctgcccacggagctgccatcctgggagaaggggacccgcatggaacaaagtgtgtagcgtgtgcagtggagagaacttcatgtggaaaaat

SEQ ID NO: 30849 - DNA, 359 bp, Homo sapiens
ttttttgagactaggtctcactctgtcacccaggctggactgcagtggcacaatcacagctcactgcaacctctgcctccctggctcaagggatcctcctacctcagtctcccatgtagaggtgaccacaggtgcacactaccatgcctgtctatttttttaaattattttttatttttgtagagacagggtctcgccttgttgcccaggctggtcttgaactcctgggctcaagggatcttcctgccttgacctcccaaagtgctgggattacaggagtgagccaccgcttccggcctacttttagaggatttataaattcgaattggtctaagttccaacatgccaaatatcctgga

SEQ ID NO: 30850 - DNA, 638 bp, Homo sapiens
aaaattgcttgtgaaagaattcaagcaacacaagaaaatccaaagaagaaagcaaagatgacatctttaattgaatggctaccctgagccaggtaattccttgttaggctgtcttgcctcctgtaggatggttagcaacatccctggcctcaactcactaggatgcccactcaactagcccagttgtgacaaagttatttccaaatatttccagatgtcaacagagaggcaaatatcaccctcaattgagaaccactgatttaatgaattcatttattcatcaactttttttttttaaacagaaggggtcttgctctgtcacctaggctgaagtgcagtgacacaatcgtagctcactgtaacctcaaaatcctaggctgaagccatcctcttgcctcagcctcctggattttgatcctaaggggtaatagtaacccaatgagaatcacacttgtcagactagcctcaaaacagtttctaactcttttaaaaagtgtatctcctttagaaatactttatcacttttaaagatataaaaggttgcactgcactctggagaaaatgtcaagagcagcttcaaagaaattctgacgagtaatccacacagttggggaggggagaagttgcatgtattttta

SEQ ID NO: 30851 - DNA, 94 bp, Homo sapiens
ccctccctcactccaccttgttctttttatttagtgacattcttggcctttttttcttccatatacattttagaattagtttgtcaagttccac

SEQ ID NO: 30852 - DNA, 563 bp, Homo sapiens
aattggaacaagagagatctggggtgaaaagaggctgaagaaagtacagcttagagctgatctgttttaggacatcagtcagacctggccagagcatttggaaatgtgctacttctggaatgaataagccaggacttgtggggaggtgtgggaatttattgatttgagttcttgggccatcatcatttttcttaaattactttttcgaggtattgcccttcttgactcagacatgaaagatgtctcctctcatttaaatcagaatgcaaaattgggaattggtcccacatcttgcatgtaggaaaagaacacttggatatagaaaaccaaccgataggagctccttctcctcttggagatcttctataagaggccatcataatgcttctctcgaccattctccagaaagtgaacctaaagaacttgaacaagaagaccaaaaaatgcaccatctctaaagaatgagaagacaagccacagactgggagaaaatatttgcaaaagacctatctcataaaatactgttctccaaaatgtacgaagaactcttacaactcaacagt

SEQ ID NO: 30853 - DNA, 343 bp, Homo sapiens
acttgggaggctgaggtagaaggattgcctgagccctggagttcaagtctgtagtgacctatgatcatgccactgcactccagccaggatgacagagtgaggccctgtctctaaaaacaaacaacaacaacaacaaaaaaaaagagagaagacttttaaaggaaaacgtaggagaaattacttgtgacctagggttaggcacagaatttgtagatatgacaccaaacatataatctataaaagaaaatattgatcaattggatttcatcaaattaaaaatatttgctctcaagaccctgataagagcatgaaagaaaaagccacagatgggaaaaaaattttc

SEQ ID NO: 30854 - DNA, 391 bp, Homo sapiens
gctcaacaaatggcaggtgctatgccaatagcacagagatctgaaagcctttagccaatatcatagagatctaaattatgccaataacatagagatctaaaagcctttttctgcatgtttgcggcttttccttgtattaaaaaaactatattgcagttctaggttggaaatctgtatgtgttttcactgtggtgcccgcaatacctagataagtgctatgtcatgggctctttcattcatgtaacaagtatttttttggctaagctctgagtgcagcaaatatacagacacaaaaatctcaaccctcatgaagcttaagttctggcatgggatgaaggtgggggagtcagacaataaagacaaactgttaggtggagatgtggtcagtact

SEQ ID NO: 30855 - DNA, 262 bp, Homo sapiens
tgaaaacgagttaaaacgatcacgtaacagcatttgtagcttgaaaaagaaaataaaagaaacaacgattagtcttaaaagaggtttactaaatactgtgtacctaagttacaaattaatgtaagccatcctacttatagtttacctttttgtgacagttataaaatcatcaatcaaatttaattgaatttaaaactaaattgcaggctgggcacggtggctcatgcctgtaatcccagcactttaggaggctgaggcaggt

SEQ ID NO: 30856 - DNA, 323 bp, Homo sapiens
ggctgtattattacttaagctatgtttacaggtagacttctaagccttctagctttccactagtaccaggtgagaaagatacgtgctcatgtactgtataatgatgtttcagtcaacggagactggaaatacaatggtgggcccttaagactgtaacaccctgtttttactataccttttctatgtttaaatacacaaatacttaccactgtgctccaattgcctacagtattcagtacagtaccatcctgtagagatgtgcagccttggagcaatggcctgtaccacagagcctacgtctgtagtagctatgccatcttggt

SEQ ID NO: 30857 - DNA, 458 bp, Homo sapiens
gtctttgagggcccacaaccctcaagttatccttgatgtgagtggaatatttatttatggatgattgtagaattttatatttttactttttagaagtaatttcttaaattacctggaaagtatgtatctctgtatatctaggtggcatgttgtaaggattatccaattagataattttccaactacctgtactaaatattcaacccttccccattggctggtgattattcctcaattgctggggaactggccctccatatggccatctgcctcactggactctgcccattaccaccttcaactggacttgctcatccctgataatcatctaatttttttaagaaaggtttttaaatatactgtgtatctgagatgaaaatattaaagccctcttgcttttcattgtgtaagtttttaaaaattccacttgataactctgaacatcttggcttaattat

SEQ ID NO: 30858 - DNA, 720 bp, Homo sapiens
gtggaggagggacagacagaggaggctcgtgcaggggaacgccagccaaggagggagcgcctgctccaagggagggggcatttgaggcacagatcaaatgattccatgatgacaaactgcctgtctcaactgaccagattccactggcaaacactccgctgaccttgggcagctccctctgctcccacctcctctggcccttgtgcttctggggctttgtggagtagctggacatcaatgataacactaacagtagccggcctgccaccaagttctttacataggggatgcctatgtctgtgcttcattggcgtcatctcacaaggccctgagctggcaggaaattgaggtctcaaggggaaaagccacctgcccccagtgacaaccaggaagtgcaagactctgacccaacgcccatgcctgccatccccaaacatgggctcaaaacccccttcccagggacggctgtgtccacccctcagcaggaggaggagaccccacagcaccgggtgagaggtcctgctggatgctaagcaccgaaacctcaacccggaacaagaccagaacaacctgagcaacaacaggaccagcgatggctctccctgctggaggattctggaagtcacctggctggaccaagccctctccgtgttctctgtcagcccactccccagagccgctaggcctgatgtgcacaagcagactaataaaggcttgagg

SEQ ID NO: 30859 - DNA, 1590 bp, Homo sapiens
gtggaggagggacagacagaggaggctcgtgcaggggaacgccagccaaggagggagcgcctgctccaagggagggggcatttgaggcacagatcaaatgattccatgatgacaaactgcctgtctcaactgaccagattccactggcaaacactccgctgaccttgggcagctccctctgctcccacctcctctggcccttgtgcttctggggctttgtggagtagctggacatcaatgataacactaacagtagccggcctgccaccaagttctttacataggggatgcctatgtctgtgcttcattggcgtcatctcacaaggccctgagctggcaggaaattgaggtctcaaggggaaaagccacctgcccccagtgacaaccaggaagtgcaagactctgacccaacgcccatgcctgccatccccaaacatgggctcaaaacccccttcccagggacggctgtgtccacccctcagcaggaggaggagaccccacagcaccgggtgagaggtcagtgctgaagccagggaggcagctctcagcagggcacctgtgtggagccagggaagccagggccacacttgcagggtgaagtggggaactcggaaggctgggcagtggagcaaaatgcttggtgccctgcgggaaccggtggccaaggctacactgggatgaagggagccgtggagctgcagaatctgcgggtggccctcagtggcaggcagccaggccaacaggggctttgggctgcaggtcagcccctcccctgctctggaacttttggagggccattacaaaggacatcagccccaagatactcctctgaaattctgcctgaaaggcccttcacattccctaattggcacttacaacattccagaacattctatggtaccttaagtttctcctccccctccaaagggcccttgaaccttaaggatagggcagaaggggctcctcaccctggcctcgagggcttaagatccagctgaggactcctagcctccctgtgtgctgggcaggaaagtagctccatgtcactgctgtccctgggaaaggaaaaaaggttgaggaagggctcagagccagccttcagaccaggcaggaagggttcagagccagccttcaggccatgcaggcctcctggatgtgcttactaactctgggctcgctgttctctgagctggctgggagttcccctctgcacccccgtttcctcccctgtaaggtgggaataatagcgtatgtctctaggattaagtgagccagtcatgcatgggccgagaaccaggtttggcatattgtagctgctcagtggacgttagctgttatgattggaccacaacgtgcttccgtttcaattctgtgggccttttggaggtcctgctggatgctaagcaccgaaacctcaacccggaacaagaccagaacaacctgagcaacaacaggaccagcgatggctctccctgctggaggattctggaagtcacctggctggaccaagccctctccgtgttctctgtcagcccactccccagagccgctaggcctgatgtgcacaagcagactaataaaggcttgagg

SEQ ID NO: 30860 - DNA, 773 bp, Homo sapiens
gtggaggagggacagacagaggaggctcgtgcaggggaacgccagccaaggagggagcgcctgctccaagggagggggcatttgaggcacagatcaaatgattccatgatgacaaactgcctgtctcaactgaccagattccactggcaaacactccgctgaccttgggcagctccctctgctcccacctcctctggcccttgtgcttctggggctttgtggagtagctggacatcaatgataacactaacagtagccggcctgccaccaagttctttacataggggatgcctatgtctgtgcttcattggcgtcatctcacaaggccctgagctggcaggaaattgaggtctcaaggggaaaagccacctgcccccagtgacaaccaggaagtgcaagactctgacccaacgcccatgcctgccatccccaaacatgggctcaaaacccccttcccagggacggctgtgtccacccctcagcaggaggaggagaccccacagcaccgggtgagaggtcagtgctgaagccagggaggcagctctcagcagggcacctgtgtggagccagggaagccagggccacacttgcagggtgaagtggggaactcggaaggctgggcagtggacaacaacaggaccagcgatggctctccctgctggaggattctggaagtcacctggctggaccaagccctctccgtgttctctgtcagcccactccccagagccgctaggcctgatgtgcacaagcagactaataaaggcttgagg

SEQ ID NO: 30861 - DNA, 602 bp, Homo sapiens
ccctctacctctgggctctgccttcagccagggttggggacagcaggtaggcagatcccatcgcagacaggcctgccttcctcagggcctcgcttaaatccacaggaatctgctggggctctgccctctggctggggcaggtggaactggccagattggcggtggggggaccactgtgcttgccatagggactggcccagctgccccacaggggagcacattggagtaacaggggaggctgacccgagcctggcccggctccacactccccacccccaccccaccatcagggactcgcatttaattgtcattcatttcccctctctgaattcaaactaggcacagatcaaatgattccatgatgacaaactgcctgtctcaactgaccagattccactggcaaacactccgctgaccttgggcagctccctctgctcccacctcctctggcccttgtgcttctggggctttgtggagtagctggacatcaatgataacactaacagtagccggcctgccaccaagttctttacataggggatgcctatgtctgtgcttcattggcgtcatctcacaaggccctgagctggcaggaaattgag

SEQ ID NO: 30862 - DNA, 804 bp, Homo sapiens
cctcctctcctccctaccgtttcatttaatggtaaaacaacagcagagctctgaaagttagccatctgcgcagagtttgccttctttaaggagggaggcgtcagacgatatccatttaaatatattttgtacttccacaaaggatggaaagggaaattcacgaagggagtggaggcggaaagggagctccgagaaagaaggaggggtcattccgcggggggcgggggggggcgggggccgacgcaggggaaagagttgctctctacaccgaaaagggactttgaccttccattgatctcgaaattcaaaaacgtttcttcacaggtcagattgtaacaaacactcgttcctaatttatgaactcgccgttttgattttattatttaagcatgcgccagcaatcgtgtttccttaagaaagaactgacctatttttggctggagataaacgatcatgttaacagatgttaatcttgtaatctgtttttcctgtaagcactttacctagccgggtttcagaccttaaaaataacatcttttccaaaaagacctgacgtcacaattcactccctgaaaaatcacactccccctccagtttcttcccctgcaatgatttcaaagacattaaatcttttccactttataaatgctgatctgttctgcctctactcccacaggctcttatttgcatttcaaattccacaggttacaccagtcgccttttcaaaaaatgtaaaccaacaatgcagcagcaaatggctttttgtgcatctggattaaataaagcacagaatgaatatattta

SEQ ID NO: 30863 - DNA, 371 bp, Homo sapiens
atgatgcgttgaggggctcaggagcaatcaaagaggcctggaggggctgggcagggttggagaagcgggagcgaggtcaagaaccacaccgtgtagcaataccaagtggtattacatgatcaatgggcgatttatgcgtgtatttgtcactccccctccagtttcttcccctgcaatgatttcaaagacattaaatcttttccactttataaatgctgatctgttctgcctctactcccacaggctcttatttgcatttcaaattccacaggttacaccagtcgccttttcaaaaaatgtaaaccaacaatgcagcagcaaatggctttttgtgcatctggattaaataaagcacagaatgaatatattta

SEQ ID NO: 30864 - DNA, 295 bp, Homo sapiens
cgccctccatcctggtcaacagaatgagactccctctcacaaaacaaaaaagaatcaatgcggatttcaggggtatgattaactggaaaataccgcggaagttatgtaacgtagcataaaatggaagtgttttgtaactgatttggctccttctgtgtaagtggggtgactgtacacttgatttagaaaccacatctactgtcctgggccaggatgcatccaaagcaagaagaaaggacctggggattactggtatccttgaaactattagtaaagcttgatactgagtaaaatc

SEQ ID NO: 30865 - DNA, 855 bp, Homo sapiens
gtttgatgctgcagtgagctaggatggtgccactgcactccagcctgggtaacagccagaccctgtctcttaataaacaaataagcaagcaggtatggaacattctcagctgggttctttaagctgtctgacaaggtttcgggttgtaatacatgcttctaatgtaaatatgttaaaatgcacataattgaaatggagtaaagtaagctgattatacgttgctttgtgcatttagactattattgtattttattttccatgagattatgaggagattgatgatgttaaaaggtgagaagaaatagagaaccatttcgatttagtctgtagaaaatgtattttcacttttttgctactatctttgtaaatgaaattgcagaaaaattacttagactcccattggtttttttcaatttgaaaatgagtatcttcgaaccaggaatatcttggggtccactgggggctagctgtctagggcactttgctgggaagacttctgagaccacatctgggctctgcaggaaggagtgctgtaaccacctttctgggtctacctgtgatcaacccgggtgtgctgtggacatcagactgaggaggagtgctacatttgctgataccttagtatgcagtattggtagtgtagaagcttagatcctctggaatggcagaaattcccagatttatattgatagggactagatttctggaaaaccatatcactgggaatatagacacccttttttatggagagggaattatggatttttaattttaaaagtctagtgtaatatatagtgtatattgagacatgaatctttccacttatcatcattcactaatttctgttaaaaaaaa

SEQ ID NO: 30866 - DNA, 839 bp, Homo sapiens
ttgagacaagagtcttgctctgtccagcctgggtaacagccagaccctgtctcttaataaacaaataagcaagcaggtatggaacattctcagctgggttctttaagctgtctgacaaggtttcgggttgtaatacatgcttctaatgtaaatatgttaaaatgcacataattgaaatggagtaaagtaagctgattatacgttgctttgtgcatttagactattattgtattttattttccatgagattatgaggagattgatgatgttaaaaggtgagaagaaatagagaaccatttcgatttagtctgtagaaaatgtattttcacttttttgctactatctttgtaaatgaaattgcagaaaaattacttagactcccattggtttttttcaatttgaaaatgagtatcttcgaaccaggaatatcttggggtccactgggggctagctgtctagggcactttgctgggaagacttctgagaccacatctgggctctgcaggaaggagtgctgtaaccacctttctgggtctacctgtgatcaacccgggtgtgctgtggacatcagactgaggaggagtgctacatttgctgataccttagtatgcagtattggtagtgtagaagcttagatcctctggaatggcagaaattcccagatttatattgatagggactagatttctggaaaaccatatcactgggaatatagacacccttttttatggagagggaattatggatttttaattttaaaagtctagtgtaatatatagtgtatattgagacatgaatctttccacttatcatcattcactaatttctgttaaaaaaaa

SEQ ID NO: 30867 - DNA, 429 bp, Homo sapiens
gttttctgctgcttgatacatttctgctattgagagactgatgcatttttcagtttgtcaattgaatttttccactttgggatttctgcttgattctttttactaataattattgcagtctcttttttaaatttataggattctgaatttgttctctgtattatcttggatttcgttgaactttctcaaagcattcagcttgaattctgtctgaaagttcacatatctcttatcacttgggaattggtcactggtgtcctttatttttagttcatttggtgaggtcatgttttctcagatggccttgatgcttgtggatgttcatcagtgtctgggcattgaagagttgggtattctgttctttgtagtctggttttgtttgtacgcattcttttttttttttttctgttttcgagactccatctcgct

SEQ ID NO: 30868 - DNA, 255 bp, Homo sapiens
agaaggtggctccaggtggaggagtggccacctgggctttgctgggttatgtcctttgcttgaatgtcaggacacccttggagtaggagcgggtgcagttctgagggctacgggcggctccctgagtcctgctgcttgacttctattttctattaaatgtgtttcgttgatctttaacatatgtatttgaagacaattttatgtgataagaaatcgaatgtataaaagtgtaaattccccagttcaccttctgaa

SEQ ID NO: 30869 - DNA, 646 bp, Homo sapiens
ggtgtaggattttggctgacccccaaaacaaaagattaaaaattatggatgacttttataaactacaagcaagtcttacaatttccctcagagacaaagatatacttctgcccactcagccctgagtagcttcaatcatggttctctagtaagttagaattatattttctccccgtgacataaatttcagtataaggatcagcaacattgctccagtcctataaatcatatgaggcaaccaaatagtctccaagattctagctcatttgctgttcatctgttttaagattgcatttcaccagtttatttcagggtgtctgccattttggccccagttttgataactgcagattgttgttattttaaagccatttcattgctcagtcttgctggggctggggccctgccttgctcttgccctcactaagctgcattctggtttcctgcctacctcccttggctttgaataaataccacatgctcttgctgtgcttttgctgtgctctgccacctgcagggcccttggtcatactgtgttgagacctccttgcaggagtggccgcttgccctttgcagccagcatttttcagataacttccctccatgctcctgaaacacatctgtctccccactgcctgcctcctct

SEQ ID NO: 30870 - DNA, 394 bp, Homo sapiens
ccttgcagttggcgtttgatttctcactgaacattcattgtcataattatagacactatgtgactatcaagggcataatattctttcatgctgcatttttattagatggcacctcaaagttttcccaagtaggtgggttttaaattatgaatatataccgtggcatagtatcttacttagtattttaataagattcttatttatataacaaattttttttattcctctgtagtgctactttagtctctgagctaattttcatgaagccaatctaaaaatcgtgttatttctaaggatgtggagcgagtgagatgaacagttgtgctgtcatattgcccctccccagtgcagatagtgaatgaggacccactgatttaaaggcaacactgcagcc

SEQ ID NO: 30871 - DNA, 891 bp, Homo sapiens
taaaaaggcagatgatcagagacggctttatacaggaggtgaatttttgtctggcttgacaagataacaaagccaggttgagtgggaagaaaattttgccaaaagaacacaagcagatttatgacagtgggaagatgctttattgaagtgaatcccatgctgtgatagaaattttctgtgaggatttaattcaaactcgatcctttttcaagtatataactatttaaaaagagaaattaagtgaattgtcagctgttggccatctgcctcaatgtgtgcttttgaagcccagcagattgcacattctgtgtaggtggatagcttgaaacctgcagacaactgtcagaggacaatgacttcagagaagattcagtgaatttctaacatcaaacttcaactactgtaatatgcttgtctagccatctctttgttgttgctgttctacagctttattgagatataactgacatacaataaactgggcaaatttaaagtgtgcaatttgaagtttcaacgtatgtatatacctgtgaaatcatcaccacaatcaagatgacgaacttatccatgatcccaaaaagtttccttctgccctttttaaattcctccttcccgcccctctgcttttgtcattatatattactttgcatttcctagaatttcatataaatggaatcatacagtatctactctttgttgttgtctggcttctttcactcagcataattattttgaaacttatctatgctgttgtgggtatcagtagctcatttccttttgttgctgagtagtatttcattgtatgaatgtgctacacgttattgattcaccattcgttgagttgtttccagttttatggctattacaaataaagttgctataattatctgt

SEQ ID NO: 30872 - DNA, 204 bp, Homo sapiens
tgctcatcggggctggactccttggttcctggggacgaagacaaaccctataagtgtcagctgtgccggtcttcgttccgctacaagggcaaccttgccagtcatcgtacagtgcacacaggggaaaagccttaccactgctcaatctgcggagcccgttttaaccggccagcaaacctgaaaacgcacagccgcatccattcg

SEQ ID NO: 30873 - DNA, 2856 bp, Homo sapiens
aggaatgcttgatgaaacattttaaaataagtcatgacatgttagcttgagaatgtattttcataattgtatacttgtttttaactttaaatgtaatttttaatcaggtaaagtttgacacatgtatagctacatacacacatttttaatggtgctcatatatactgtattttttgttgtttagttttacttattgagagtgtcacaacatgaatcacataatcatgattttttttttttacttttactccccaaattattcatgtttcttagatcgtagtcattgagaagtcccaataactctaaacttttgagttataacgtagtaaacttctctttcatctttgtgttagctctgtagtcttaacctggattttaatttttttgtttccaaagtcacaattgaattattcttagataccttaagccactgaattcagttctgtttgactgaaagcaaaacaacgtgacagtttattttcaaacactaacttcttgatattttgttatggtatatctttttattaaatatttattttgactaagctttcataaaatatttgaagctattttaatcatcaagtatggaaaacaaattactattgcattttcctatatatgcatatattatggattaaccagaattgtatcatttttggcctaatgtctggatataaaagataattagcctactatagtattaataaatttttcagttggtttgggcaaatttaaacctgaaaaataggttaaaaagtagttacaaattaaacttactaatttatacctgattttttttcttgaattaaagtacattttaaatgagctttataataccttaaaaagttggttctaatttaaaatatgaaagctctggctatcatcctgggatagtaatttctaattatatagtatttcaaaactatatattttttagttcctttgagataactaatttctaattatatatgtttcaaaaaccatatcctgtattttttttaagaattgttttataaataggtcataagatacaaggtctgcattagaagacccactcttactaggttccctaaggatctgccatagattttttttttttttttttttttttaggtagtttaaagcaagcactgataccagtgggagttggtcttgatctaggagattctgttaagcatccaaaaacaatgcctaatttcagttcttaggttatggcttgtgactccagataaaagatggagaatacctcatgtactgtgacttgaaaatgaattcttaaaattcttaggctctctccatgtatctttcttaaggaaaagtttctgagtgtgatctctcttttgccatagtatcaagtggagggtagttcagaaaagttaataggaaatcttttgtgacagcagactataatagaagtttgagtaatattttaataaatttatataattcaaatgataaaaatgtatcaatgttatccaatgatttttattaaaaaattaccttattattagaactgtgcctattacataaaaagtgctcatgtatttgaattttaaataatttatttaaatcaagaccaccataagtcattaataatttaataattgttttaaatcagtggttttcaaccctcacttcatattagaatcatctgaggacttttaatatggaatccacctcataacaattaagtctaaatttctggaagatggagccatgcttgtttttccaaaagctctttgagtgattctaatttgtagtcagagttgaagaccactgctctaaattagtgcaggaaaatgcttttatttctcccatggttaacttttaaaactagtaatgtacccagttaagttttgatggtttaaattccactaaagaacatattcttctaataactagcatttattacatgaaatttaagagtttaagttccatcaaactagcccttgtgtaagattattatttcttctctataacttcaaaatagatatttcattcaaactgttcaggtgagaaaacataatggatttttttttttttcctctggagctgcctgttcagtgagatggaggaggtgggcacatttaaggtcagttcactaacctatggttcagagttctgatcatatggaagtttggaaaagagagcttatcacaggtttgtatgctggtgaatggatagttttaattctcactgtctcaaaagagaatcagctctccagcagttctagaaaagctttgacaatccccaaggggcagtgttaccttactccttcactgcttcttagaaggtagaattaagtttctggaattgcacctacatgttttcttattaacattcagaattgggaatattaatttttccagtgagtagttttctgaaattggtaacttggagagtaaaataacgtattttgcttttcaattttgtgtttgtttacttttatgtaaaaatttgatatgtgaattacacagttctaataaaacctcatgccttttcattacatctaatttgaactctcaacttcatgttacagaatgctttaaagatgctttaatgaaaagtattaagaaaatatatagatttgtatgtcagtttatacttcagaaatccatatatttgtcatatttatttttttagaaacctcctaattggataactagatggtatttaaaatgaatgcccaaaaatatcttgtacctttgtccaaaagtttatctgttggaagccgccagccattcatgtagagagtttataagaaaataatttaaaattgtatgcattttatattactatggtatctgtgtaccatatttctaagtattcattattaaattggtacttcttaaaacc

SEQ ID NO: 30874 - DNA, 2659 bp, Homo sapiens
aggaatgcttgatgaaacattttaaaataagtcatgacatgttagcttgagaatgtattttcataattgtatacttgtttttaactttaaatgtaatttttaatcaggtaaagtttgacacatgtatagctacatacacacatttttaatggtgctcatatatactgtattttttgttgtttagttttacttattgagagtgtcacaacatgaatcacataatcatgattttttttttttacttttactccccaaattattcatgtttcttagatcgtagtcattgagaagtcccaataactctaaacttttgagttataacgtagtaaacttctctttcatctttgtgttagctctgtagtcttaacctggattttaatttttttgtttccaaagtcacaattgaattattcttagataccttaagccactgaattcagttctgtttgactgaaagcaaaacaacgtgacagtttattttcaaacactaacttcttgatattttgttatggtatatctttttattaaatatttattttgactaagctttcataaaatatttgaagctattttaatcatcaagtatggaaaacaaattactattgcattttcctatatatgcatatattatggattaaccagaattgtatcatttttggcctaatgtctggatataaaagataattagcctactatagtattaataaatttttcagttggtttgggcaaatttaaacctgaaaaataggttaaaaagtagttacaaattaaacttactaatttatacctgattttttttcttgaattaaagtacattttaaatgagctttataataccttaaaaagttggttctaatttaaaatatgaaagctctggctatcatcctgggatagtaatttctaattatatagtatttcaaaactatatattttttagttcctttgagataactaatttctaattatatatgtttcaaaaaccatatcctgtattttttttaagaattgttttataaataggtcataagatacaaggtctgcattagaagacccactcttactaggttccctaaggatctgccatagattttttttttttttttttttttttaggtagtttaaagcaagcactgataccagtgggagttggtcttgatctaggagattctgttaagcatccaaaaacaatgcctaatttcagttcttaggttatggcttgtgactccagataaaagatggagaatacctcatgtactgtgacttgaaaatgaattcttaaaattcttaggctctctccatgtatctttcttaaggaaaagtttctgagtgtgatctctcttttgccatagtatcaagtggagggtagttcagaaaagttaataggaaatcttttgtgacagcagactataatagaagtttgagtaatattttaataaatttatataattcaaatgataaaaatgtatcaatgttatccaatgatttttattaaaaaattaccttattattagaactgtgcctattacataaaaagtgctcatgtatttgaattttaaataatttatttaaatcaagaccactgctctaaattagtgcaggaaaatgcttttatttctcccatggttaacttttaaaactagtaatgtacccagttaagttttgatggtttaaattccactaaagaacatattcttctaataactagcatttattacatgaaatttaagagtttaagttccatcaaactagcccttgtgtaagattattatttcttctctataacttcaaaatagatatttcattcaaactgttcaggtgagaaaacataatggatttttttttttttcctctggagctgcctgttcagtgagatggaggaggtgggcacatttaaggtcagttcactaacctatggttcagagttctgatcatatggaagtttggaaaagagagcttatcacaggtttgtatgctggtgaatggatagttttaattctcactgtctcaaaagagaatcagctctccagcagttctagaaaagctttgacaatccccaaggggcagtgttaccttactccttcactgcttcttagaaggtagaattaagtttctggaattgcacctacatgttttcttattaacattcagaattgggaatattaatttttccagtgagtagttttctgaaattggtaacttggagagtaaaataacgtattttgcttttcaattttgtgtttgtttacttttatgtaaaaatttgatatgtgaattacacagttctaataaaacctcatgccttttcattacatctaatttgaactctcaacttcatgttacagaatgctttaaagatgctttaatgaaaagtattaagaaaatatatagatttgtatgtcagtttatacttcagaaatccatatatttgtcatatttatttttttagaaacctcctaattggataactagatggtatttaaaatgaatgcccaaaaatatcttgtacctttgtccaaaagtttatctgttggaagccgccagccattcatgtagagagtttataagaaaataatttaaaattgtatgcattttatattactatggtatctgtgtaccatatttctaagtattcattattaaattggtacttcttaaaacc

SEQ ID NO: 30875 - DNA, 373 bp, Homo sapiens
ggctaagtggagctgcagacaactttgacccgtttgacaaacttactgtgggctcagctcactgcaacttctgcctcccgggttcgagtgatcctcctgcctcttcctcctgagtagctgggattacaggcatgtgccaccactcctggctaaattttgtatttttagtgaagacgggctttcaccatgttggccaggctggcctcgaactcctgacctcaagcaatccgcctgcctcagcctcccaaagtgctggattacaggcgtgaaccaccacacctggccaaggttagggtttaatgggcacaaagtttgttaaggaagataaaaagtttcagagatggatagtagtgatggttgtacaacactgtgg

SEQ ID NO: 30876 - DNA, 411 bp, Homo sapiens
atggcccgaaccaagcagactgcgcgcaagtcaacgggtggcaaggcgccgcgcaagcagctggccaccaaggtggctcgcaagagcgcacctgccactggcggcgtgaagaagccgcaccgctaccggcccggcacggtggcgcttcgcgagatccgccgctaccagaagtccactgagctgctaatccgcaagttgcccttccagcggctgatgcgcgagatcgctcaggactttaagaccgacctgcgcttccagagctcggccgtgatggcgctgcaggaggcgtgcgagtcttacctggtggggctgtttgaggacaccaacctgtgtgtcatccatgccaaacgggtcaccatcatgcctaaggacatccagctggcacgccgtatccgcggggagcgggcctag

SEQ ID NO: 30877 - DNA, 310 bp, Homo sapiens
attcaatatgtttttaaaggtgtgattcttaaattctttatgattgtttagatttctatatcttggtaacatgaatacacacttaatgaaagatttcagtaatttttgatttgggaattaatcatagtgggaaaaactgtttaggaaaacatgtcagtggaaattaactcgccacagtatgtagtgttagggaatagcttctgttcggcatttgatttgagtgctgtattctgacatttttcaggaacaaatacatgtgattcatcttctataaatatttgcagtttcttcaagttgaaatgagaaaagc

SEQ ID NO: 30878 - DNA, 123 bp, Homo sapiens
aggagatggagagggtgctgggatgaagaggcagaaggcagcaatgcctcagggggttacacacaaccatttttgtcttctctttccttttcccaccagcaggcatgcaggggcagagctgcc

SEQ ID NO: 30879 - DNA, 951 bp, Homo sapiens
atgcctggtcagaactacagaaccatatctgaatttatcctctctggcttctcagccttcccccagcagctcctgcctgtcttgttcctgctgtacctcctgatgttcctgttcacattgcttggcaaccttcttatcatggccacagtttggattgaacgcagactccacacacccatgtacctcttcttgtgtgccctctccatctctgagattctgttcactgttgccatcacccctcgcatgctggctgatctgctcttcacccatcgttccatcacctttgtggcttgtgccattcagatgttcttctccttcatgtttggcttcactcactccttccttctcatggtcatgggctatgatcactacgtgaccatctgccacccactgcattacaacatgctaatgagtccccgtggctgtgcccatcttgtggcctggacctgggctggtggctcggtcatggggatgatggtgacaatgatggtttttcacctcactttctgtgggtctaatgtgatccaccattttctctgtcatgtgctttccctcttgaagttggcctgtgggagcaagacatcatctgtcatcatgggtgtgatgctggtgtgtgtcacagccctgataggctgtttgttcctcatcatcctctcctttgtcttcattgtggctgccatcttgaggattccttctgctgagggccggcacaagactttctccacttgtgtatcccacctcactgtggtggtcatgcactatagttttgcctcccttatctacctcaaacccaagggcctccattctatgtacagtgatgccttgatggccaccacctatactgtcttcacccccttcctcagcccaatcattttcagtctaaggaacaaggagctgaagaatgccataaataaaaacttttgcagaaggttctgccctctaagctcctaa

SEQ ID NO: 30880 - DNA, 479 bp, Homo sapiens
gcaccaccatgcccagctaatttaaaattttttttgagacaggttctcactttgttgcccaggctggtctgaaactccgtgccgccaaggtaggcggactgcttgaggtcaggagttcgagggcagcctggccaacacggtgaaacctgtctccactaaaaatacaaaaattagctgggtgtggcagcgcatgcctgtaatctcagcttctagggaggcctgaggcatgagaattgcttgaacccgggaggcagggtttgcagtgagatgagatcgtaccacctcactgcagcttgggcaaaagaacaagactatgtctcaaaaaataaaaataaaaaagaaatcttatattcattagtagtcactccccattcatctccacaccttacccttagccctaggcaactactaatttagtttctgtatctgcagatttccttattctgaacttttacataaattaaatgatatgtgatctc

SEQ ID NO: 30881 - DNA, 462 bp, Homo sapiens
atgatctccaggtataaggaatgcacaaattagttttcctgtgacagcatgcagagcacttttccaagccccgtcacctgtccttagttcctctgaactatacagaggaacaaatcaatataaatgcagaagagaaaagatgagatcagctgattttggtgttgatatgggtaatatctgatttacattcagttttcatgtgggatctctgtgcctggcttggtttaatgattcaaagtgacaatacagtcaacttctgagaaaatgatctatggaaaattgaaagtttaaaatattttcttcctcctaactttgaagaggacttgtttcatatcaaatctgcctgttcatctgcctgtccgtccactcactgtttatccatggatcttggtgttagcttctgaggtggtaatgaattcaaaacccttctgttcctactctcatattaaaggttcaaaaatc

SEQ ID NO: 30882 - DNA, 339 bp, Homo sapiens
  misc_feature (283)..(283): n is a, c, g, or t
  misc_feature (322)..(322): n is a, c, g, or t
caactaataacagaaacaaaaactgtgcctatagccgagtgggtgtggtaggagctcttttctgtattatcttgctcttctttaaattttgaattctttgcaccacacaataaatgaacgtaccttgtattattgtaaatattcccccatcactaacatatttgtgtttggtttctgttcagccctcacggcagccctcacctgagttgtggttgttcactatctgtactccctcagatgaagaaactaaggtgctaaaatgcatatgcccaagcataccaancccctaaggaaaggaggtaacatgtgcctaggcaatgtngcccctggtgttaatac

SEQ ID NO: 30883 - DNA, 345 bp, Homo sapiens
tgtatcctgtaactaacccagtatagaacagtaacactgtttacactgattggaaggaagaaggttcatcctggcggtttatgacattgccagaatggcttgaatccttgagggtgggtgacaggtagagtggataataaatgggcctcctggttcacagagcctgagaacctctcacccaatgggcacctggtgcccctgcagagtccagtctaagaggacaattttttttttcagatgtagtcttgttctgttgcccaggttggagtgagctgagatcacgccgctacgctccagcctggtgcgacagagtgagaccccgtctcaaaaaaaaaaaagtcgacg

SEQ ID NO: 30884 - DNA, 419 bp, Homo sapiens
tttttttttttaaatgagatagggtcccattgttttccaggctggagtacagtggtgcaatctcaagtcactgcaacttctgcctcctgggctcactccatcctcccaccttagcctcccaagtagctgggactacaggcatgcactaccacacgcagctggtttttgtatttttagtagagatggggtttcaccatttcacccaggctgagaatacactttttaaacttagagatacaaaattagaattgccagtcataggttttcttggaatacacatgctacaataatgtaggagtacctgataagaattcagtaaatatttgttgaatgaaggagagaatgattgaatagcagagattcctaggtctgtggtattggcacttaaatactttcataattttatccagaaacaatcc

SEQ ID NO: 30885 - DNA, 283 bp, Homo sapiens
ttaagcaaacatttatgacacccttcctagacacaaggacactctgccccggtgctctctgtgggatcagctctttctttggctccttgcgctttggtttcatttctgaaatgattttttatcttttctttaaatttcttttcttagtctgtcaattcttatttcacatgctcttactgtctagccatctctgctctgaatgtctttacctccgctttgtgaactcactgcttaactaagttacaaaatgaatgttgaaagtactgccaatttttctccactt

SEQ ID NO: 30886 - DNA, 411 bp, Homo sapiens
gaccatgttgagccctacttttgttctgtgggatgttggatatcccttatacacctatggctccatcttcatcgttattgtaattatctggcaagtgaaaaggagccaccatgaattgaacttggaagttgaaaggagctgctgctggcgtcaccaaaaagtcaggcaaagagctagagatgcagcatcaacaggtgaagtcccaatctctcctctgactcccttccactgtgggtgtttcctatgaatcctgtccctctatgacccctggagccaagagccaggtgctctgccactgaagactccagttccccagactgaaacttccatgggtgggaaatcttaccttggaaacgttccaaaattctctacattattcccatgggaataaagaattgaggaaataaaaca

SEQ ID NO: 30887 - DNA, 488 bp, Homo sapiens
gaccatgttgagccctacttttgttctgtgggatgttggatatcccttatacacctatggctccatcttcatcgttattgtaattatctggcaagtgaaaaggagccaccatgaattgaacttggaagttgaaaggagctgctgctggcgtcaccaaaaagtcaggcaaagagctagagatgcagcatcaacagctaggagactttctcaggaagaagatcagaagccacaagagctgttctctgtcatgaaaagccagggctggcttcccccagagggaagtgtgcggcgaatcctatgtacagatccctgttgccaaatttgcaatgctatggctctggagattcagcagttgctggcggatgagaatgactagatctccccaactttgtcgaggagtccatcacaggtctcctcttgcctagagatcttgtctctgtctagtgtatcctttgagcagagtatagagctccattccagaaatatca

SEQ ID NO: 30888 - DNA, 505 bp, Homo sapiens
atcctgggtagttgacaatggctaatagaattaggtggaaagatcatgcatccatctatgtactgcacattgcatactgaaatctgaaagaatgtttttgcaaaatgacttaatcatacttctctgagatcaaaatctaataacattactttcataacgtgaatttgttctatgttgacttttagtacttgaaatacaggcttaattaaaaatttgttggccaggtgcagtggctcacacctgtaatcccagcattttgagagattgaggtgggtggattgcttgagtccatgagttcgagaccagcctgggcaatatggcaaaaccccgtctctactaaaaatatacaaaaaattagctgggagtgatgctgtgcactgtagtcgcagctactcaggaggctggtgggggaggatcacatgaactcaggaagttgaggctgcagcgagccatgatcacgccactacactccagcctgggtgacagagcgagaccctgtctcaaa

SEQ ID NO: 30889 - DNA, 364 bp, Homo sapiens
gcttaaaagacattgataaatttagtttgactacaaacaggtggagttttgaacattagaaaatgctccacagccgggcatggtggttcacgcctgtaatcccagcactttgggaggctgaggcaggcagatcacttgaggctgggagtttgagaccagcctggccaacatggtgaaacccctgtctccagtaaaaatacaaaaattagccgggtgtggagatgcacgcctgtaattccagctacacgggaggccgaggcaggagaatcacttgaacccggagagcagagtttcagtgatctgagactgtgccactgcattccagcctaagcaacagagcgggactcttgtctctataaagaag

SEQ ID NO: 30890 - DNA, 503 bp, Homo sapiens
attctccctccttctcaatttttcccatttaaggaaaatcttctggccctgctatttctttcttcttcatgtctctccctctcagatacaacgcattctcttcattcccactgtcttatcctggtcctcatcagctcaaactgtctcccaaccggcttccttggcccttacaggtctgtcccttcctcaagctatgccttaatgatgcgaatcttaaagcatttttgctagtatcactcctcaagctcaagaagcttcagtaactccccactatctcaaagctctccttaatctagcctcatctctggatccaacctttacctctaacaaggcaggggctttccaccactcttgtcaaaatgagtctcttgcatccttctcatgacatcagctgtcactcacctccagtcccacatttcctactgcctgctcaacatttcactggatggcctgctactgcctccaataaaataatgatcaatcctacttctgtgcctctgatt

SEQ ID NO: 30891 - DNA, 529 bp, Homo sapiens
ctgctcaggcgctccttggggtcgcgcatggtctcggacagggtttgcaaggacttcgaagctaaccagtttggagccataaccctttcgtacttgccaaaaaactctgggcaagactcttgaattttgagccgcagtattctcgttcataaggtgagaataaaaacatcacctagggttgatgtgaagagagatgaaatcattgtgaaataggagagttattgctttcaaccaatgacattttctggaaacgtgctggagatatggctgcagcagtgacgcctgcaaacgacgttcctgtcatcatgatgctgacattttaattgggaagcagattgaaacgataactaaggaatttgacaggagcatttagtaggacctgtaaagaaattaaagcaggtccgaggtggagttttgtaaactatatgcctgaatagaactttctgtttccaagggaattgttacagttggagacatgtcaattattacaataagcgtcaagggcaataacagaggtgttttaaagcta

SEQ ID NO: 30892 - DNA, 317 bp, Homo sapiens
atttatcacataaaatctgtttctcccctttccccaattctcagaaactgtttatcctagaaatctaattcccttaccagatagtgccatctgggtgactgggacacaaaaatcacatgggttctttctgtagcttaaacagattcttacaagagaaaatacataactaaataatcacttaaactaggcatatacttggaaaaatcatctataattcctgtaaccgagaataaacaattgttgacgttttgtcctgtttgccaccagttttttcctgtgtattaagctttaaaaatatacgctgattaagtatatta

SEQ ID NO: 30893 - DNA, 161 bp, Homo sapiens
taatcatcaatggttccccccattctacaacatactgatgcactctggtatcttccaataaatattcatttctttctctcctcgagttaaaggagtgcaagggctttgttttattttttaaatttttacttttttttttgagacaaggtctcactctgtca

SEQ ID NO: 30894 - DNA, 367 bp, Homo sapiens
tttttttttgctttgttgattatttaaaagtatgttatttagtttgcaatgatttgggaatttttacagatatttttctattgtcaatttctaattaatttcattttagtcagataagccatgttttatgacttgcatcattttaaacttaccgagacttgctttatggtttagaatatatctaattcaatacatgtctggtgtgtatttgataaaaatctattttatattggtgttgattgcagtgttgtgtaattttcagttaggtcaaattgtgtgactagttcagattttccatagtaatattctatctacttattctagattttttagatatggcacaaagaggaggagtaattttaaaggt

SEQ ID NO: 30895 - DNA, 1230 bp, Homo sapiens
caacagtgtgtattctggagttaaaacattcattgagttcttaatgatggttattatatttctcagtttatgagtttctatttggttcttttctaaatttctttgctaagatgtttaagtttagcttgtccccttcacaacttttgtaaagttagtgctggttcccatttatgttgctttctttcccctggtgcctgcttatcttagctagacgttatattagaaaaaattatttgacaaaattgtttgaggcttgggtgatatttttctacataaagcattttcttttttttctttttctttttgtttttttttttttttttttttcttgatgaagtccagctctgttgtccaggctggagtgcagtgatgcaatcttggctcactgcaacttccaactcccgggttcaagcgattctcctgcctcagattcctgagtagctggtaatacaggtgtgtaccaccatgctgggctaatttttgtagttttagtagagatggggcttcaccatgttggccaggctggtctcgaactcctgatctcaagtggtccacccacctcagcctcccaaagtgctggaattacaggtgtgagccaccacacccagcaataaagcattttcatttgcttctattgagacaataccctagaagttttgcagtggcagtgtgatgaccaatgaggtttatctgaggtgcgattattgctaattgaagcagtgccctggaggtactagaattccttatcagtttcatacaatttcagggcttgattttttataggttacccagacaattcattcaagggctgctttacttatggttcacatgtcatgtaaggagcagtggttttgagcataaactctattcctgggatttatcagataccccacttttgacaggtcttggatttcacttttcagatcctttttaggattggcaaatcgctttcttcactgtcctctagcaagacaaaaagtgattcaactccccagcactttggaaagccaaggcagaaggattgtttgaggccaggaatttgaacctagactggtcaatatagcgagactctgtttctacaaaagaaaaatttaaaaaattagccaggaatcgtgctgcatgcctgtagtcccactacgccggaggatgaggcaagaggatcatttgagcctaagaggtcaaggctgtagcaaacctggatgacagaacaaggccctttctaaaaaaaaa

SEQ ID NO: 30896 - DNA, 414 bp, Homo sapiens
ccattccaatgtaggtccctcagaagccaaccctgagacagggattgagtgctagcagatattttaggaggtaatcccaggaagcaacagtggcagtgtgagcaagtgatacagggtagggaaggggtaagttgagaatgccctaatgggcgggtgaacactgtggacaaacagaagctcagtcctaatgagggcctcggggccaccccatacagcacacttagagttttctatccatggttcgaggaagctgaggtctttataaccactaccactcatcattgtttgagggctgctcctagggaaattaattcccttgcacctctagcacgcttctcatatagacagaacatgctcccagaccagagaaggacctcagccggaaagttctctgcagcacaaagtcctccaagt

SEQ ID NO: 30897 - DNA, 434 bp, Homo sapiens
acaaaatcttacattttgaaattgaagatatctaggtggtagcaatgaagtggggagaagtggtaggattatggatttatattgaaggtgctgctgagagtatttgcctacatattggatataagtgtaataaaaatagaggagtcaaggatgactccaaggattttgacttgaattgctggaagagctctaatagatcaattaaacaataatgaacacctcaatgacaaaaagcaccaaaatagaattgaaatttaacaaagagtgatttttctttttaagcagtattttctagtacactttaattgaggaaaagtgcacaaatcataagtatacaactgcagaaactttcacaaactaagcaaatacagcatgtagccagaacctagatcaagaaacagaacatcacctgcactcaagaagcactccaaaaa

SEQ ID NO: 30898 - DNA, 319 bp, Homo sapiens
ggtcgacttttttttttttgccattcaaaagtcctaagagcaatcaatggcaaaaggaaaaataatacaacataggtctctcaaggatttaatttcatgttaaatatagtcccattctcataattactaatattgttttggtcagttgtgtacgttagtagtggtagcttaaatcagaagaacccttgaagagcctgtgttgaaattgaatccttgagagacctatgttgtattatttttccttttgccattgattgctctaaggacttttgaatgatttaagtgactggtgactggattcagttatgcataaagcatt

SEQ ID NO: 30899 - DNA, 376 bp, Homo sapiens
cgccggctgctgcgaggaggaagcagaggaggaactggcttgagggaggcgcagaattttggagtgggggacgtggttgaaagtacaagtaaggccgggcgcggtggctcacgcctgaaatcccagcactttgggaggccaaggcggacggatcacgaggtcaggagatccagaccatcctggctaacatggtgaaaccccgtctctactaaaaatacaaaaaaattagccgggcatggtagcgggtgcctgtagtcccagctactcgggaggctgaggcaggagaatggcgtgaacccaggaggcggagcttgcagtgagccgagatcccgccactgcactccagcctgggcgacagagcgagactccgtctcaa

SEQ ID NO: 30900 - DNA, 237 bp, Homo sapiens
ggtagatttaacgttcttctcacgctctgcagtcagtttgacttgagtctatgagtttttccagcaaatgaagaatctacttctacttcctgaaaactcttctaactagtctttccccaggtttctttctttctttttttttttttttaataactctaagtgctaccatgaagacttcagaacagttcaaagaatccttccaccttcgactgtggggataagagtcaggggagggga

SEQ ID NO: 30901 - DNA, 477 bp, Homo sapiens
cagtgcagtgttgtgatctcggctcactgcaacctccaacctcctgggttcaagtgattctcctgcctcagcctcctgaatagctgggattacagacacatatcaccaagcctggctaattttttttttttgtatttttagtagagacagggttttaccactttggccaggcttgtttcgaactccggacctcaagtaatctgcctgcctcggcctcccaaagtgctgggatcacaggcatgagctgccactccgggctccctgtgaatgttttttgaatgagttgtatgtgcttaaccttaaacgcaacttttttttgagaatttgaattgggaagaaatcaaaataattattcttatatgttatactagctagtttctttgtgatttgcaattattttgaatatgttgtatttgaataaactaataaaccgacaggataatactgtgttgttttacctacattgtgtctaaaaaa

SEQ ID NO: 30902 - DNA, 424 bp, Homo sapiens
acacacacacgcagagaatatatacttttctgggcaaagtatctgtagcttccctcaaactctcaaatgtgtctgtgacccttaaagtttaagaacactggtctagagagaacccaaagtgttgtgggccactgtgctcccttggccaccagcctctcagatgccagaatcttgagagagcacaccaggcctctagtgtttctgcttaggcatgaactgggatacagtatcaaatattgctgaagttcacaattataactataaatgtacagctgtcctttgggatgccccaagtacttttatttatttatttatttttttgagatggagtttcgctgtgttgcccaggcaggggtgcagtgagccaagatcgcgccgctgcactccagccttagtcacagagcgagattctgtctcaacacaa

SEQ ID NO: 30903 - DNA, 218 bp, Homo sapiens
gaaaatataggacttgtctgactttgggaaggaagaatctcttaaacaagatacaaaaagtgctaatcataaaaggttgataaattcgtctacattacaattaatatctcttcagtgaagtacatcatataatcacgaactgggaggacatttgaagtgcctataactatcaaagagctggtcatttggaataatttgagaactcctacaaatcaata

SEQ ID NO: 30904 - DNA, 399 bp, Homo sapiens
tgagatcctaatctaatgctcctcctacactgttgcctcatgaaatgaaaataaggttggcatagactcatttgtcaaagatgttcattcaaacattatttggtgcttactatgtgttaggcactggggattcagttagtaccctcatggagattgtagtaagtggggaatatagtctatctgtgattatctgagttaagaggaatgattaaaatgattgaaattaaagttctttatgagttttctgatccatagccaacagaacataaaaagttgcaaatgtggccaggcgcggtggctcacacctgtaatcccagcactttgggggtcgaggtgggtggcccatgaggtcaagagatcaagaccatcctggccaacattgcaaaaccccgtctctac

SEQ ID NO: 30905 - DNA, 808 bp, Homo sapiens
aatattgcactatgaccgtggaggtgagcgagcacttcatggtcttttgtgagtaggttagaagggggagcctttggttgttcagccagcttgtctttttcctcaatgagagcaatgttttccaaactatttttggcttcagatacctcatagtgactaaaagtgataaagccatatggaagaactttgcccaatctcctagctctgtccaacaaggtcatgggcaatgacaatccaataaaaactagtggtgccactaaaggatcccgagggaacaggctattcaagacagtggcacaaaagctaaacttaggtttaaaaaaaaaatgatcactgattttcctcccttttaggtctttgagaaggaagtaaaggtgttgactttttgataaggttttgtttttgtttcaattaaactttttggagaataccattgtttttcatttgttggtttgtaaatcttgaaaattatgagaaatgtagattattgaaagaaaaaattagcaatacagattataaaaagaagaaaatagcaatcatgaatagcctcaatacccgggattaaacattgttaacaatgtagcatatttccttctagtcttttttcttatgtactatttcttaagtggctaaattatatactataaatagtcttgataaaataaatttgtaagctgtccttagattaagcaaggaaacaaaatcttttagttgtaaagttaactatggagatgatcagactcagggtatttatttagcagaaataccaaatgtggaattctctggaaaattcaaaaccatcaatatc

SEQ ID NO: 30906 - DNA, 434 bp, Homo sapiens
tagttatctattggtgttcattcttttctctggtgacttacaagttcattaagtatggtagtgtgcttaggaaactcttaccctaccccaggattacctacaggattactcactctttcttacgctctgactttcttatagttacatttaattctgtattcacttggaaatgggtagagaagaaggatatggtgtgaggagggaaactacctcctttcttcccctccaaaattacttatttgacataatacagttattgaataattcatactttcccccattggtttgaaatgcaaacttcattatgtattactttgttacatataatcacttaagaatttctcaggtctcttcagtgattatatgtaacaaagtaatacataatgaagtttgcatttcgtcgagcggccgctaatttagtagtagtagtaggc

SEQ ID NO: 30907 - DNA, 1056 bp, Homo sapiens
ggacgagggtaaacggaaacagccattaacgttaatgctaggaaactctgttgtaaaagggagcagagtaattggcaacagctaagagggatcttaggatctttttaaagatgggggatatttataacatccttgtatgatggaaactaaataaaagagagttttctttccttcctccaggtttcagggctctgaatcctatttcaattgtgagaatgctaaaaaggtacatctgtgatgtgacaggtaagatggggtcctttggagagtcgcctgcttcttctttctggcttcagggagagagagaatagcaagggcaaggctcgctgggcagcttaaatgtggaactgagtttgaagaacatgttcttcatgcaccctcacagtccacaaaatgactttaaccatctttttattcccctcccactgttccctcagctggagtttcagcagttaaagatataaagaaaaatgtttaaattctaaagagcagaaagttcaatagaaataaaacttctgggacaaagcagccccagttgcaggcagaccaagtactgctgattaccagcaagaaagccttcattgtaacagggattttaccctttctttggcattcctaagtaacaaaagagaagtgctgcaaaccaacgataattagcaatagttttattcacaccaaaatcattctaatatggtgcttgaaaaagcaaaataatcttttcacttaacagaaaaaaactgtactatttttgagcaactgaaagtcacgtcaatatattaattgaatgacctataattgctgcattgttctgatgtttatcttagaccctgcatgagtggtttttccttgatgctaatcccattagaagtaaaatggaccgcagttttgaatctctctgttccttaaaaaaaaaaaaaagttaattgacaagctgtttaatatgagatgccattttacagatgaccagattgaataataaaagaactaagggggaaaatgagcttttacctgtttcacaggttttaatatatatatattcaaaaatttttctaaaag

SEQ ID NO: 30908 - DNA, 482 bp, Homo sapiens
tgagacggagtcttgctctgtcgcccaagctggagtgcagtggcgtgatctctgctcactgcaacctctgcctcccaggttcaagtgattctcctgcctcagcctcctgagtagctgggactacaggcgtgtgccgccatgcccggctattttttttgtatttttagtagagacagggttacaccattttagccaggatggtcttgatctcccgacctcgtgatccactcgcctcggccccccaaatactgggattacaggcgtgagccactgcacccggcctggaacatgtatttcttaaagggacaggtaaagaagaagagcctaaggagtagccaggagttaaactaagaatctagaatgttttagaagtcaaaggaaaagtttcaaagtaaagtagtacagtgctatagtaaggtgaagatataggctggaaaatatccactgaatgtgaaagaggtattctcaccaacatctacaat

SEQ ID NO: 30909 - DNA, 476 bp, Homo sapiens
acaactggattttaactgcgacttgggaacagaatgttgcaaatcgcgtggctggatgaacttttcagcgtctccattcctgacacatttccacagaagccctttcagctgaaggtctcagacctcagctgcctccttcccaacgagaatgcattttaatagtggtacaggcccgtgggtctgtgttttcacagagaactgccttggctccagggccaccttggccgatattcattttccaaagataaaataaagcagcagacaactagcatgcaagggcatgctattggaatcaggtgtaatagtaggaattcgggagtgagcagggctgtaggccatccactcaggggttctgaaggctcttacaaatggggaaattggttccaagaaaatgaatagcagagattccttaggccacattgcgaacatattggcattttgttcatttttgctctttttgataaagcaaaaaaaaa

SEQ ID NO: 30910 - DNA, 516 bp, Homo sapiens
ggggccagccaatgccacattacaaattagtgacgttgggccctggtacttcagtaacagtgacaacccccctcagtttctttcagggtcctcctgtgccccttatcttttagagattaagaccacagatttgggggcaaaattttcaggattagaacctcagttctgccattgccatttagtagccagtgtaactttaggtgagtggctttatctctctctcttttttctttttcttttttttgaaagtaaagaaataaagaaataggcagaacacccggctttaatctctttatgcctctgctctctcatctgtaaagtggggataatatcatagtagcatccaccttaaagagttattgtgggaatttaaatgagttattagaacagtacctcgcacgtagtaaacgctgtggacaggcagtattaacaagggtttcagggaggcatttagaccacacaataggctgagagacagaagtgatgagtttggtgccaatcataatatagaaagac

SEQ ID NO: 30911 - DNA, 372 bp, Homo sapiens
ctcccctccccaggccccagcccccacccccagccagcaggcaaaccctgaggtgctgggatgaaaaactgccccaggagaggtttgctgtcagctgggtcatgcagaccttctcacatagtggctgctaggagctgaattatgccccctcctaattgttgaagtcctaattcccaggacagaatgtggctgtggttagagacaggctctctaaagagataattaagttaaaataaggtcattaggatggccctaatccagcatgactggtccgtataggaagagatgatacttgggaggctgaggtgggaggatcacttgagtccaggagtttgagtcctgcctgggcaacatagtgagaccctgtttctg

SEQ ID NO: 30912 - DNA, 543 bp, Homo sapiens
actggaaatactgtgtgtgagacatgagtaggatatgggttttatcttggcttcctggagtgtagttttgaggaatctggggccccattttctaccgtgttgcctatgggtttaggagggagagcatttatttatgcttgggtatttgttatctctgggctttttggaaattactaaagatgaatggtaaagtcagtgtgggaaaccttgtggaggagaaataaatagccagtgtttataaagggtggttattttttagaggaattgttatcaaatgatagttaatgcttattgtagcaaaatttaagtagtttgaatttctttgggttgatctttttttaaaaaaaaaattaggataatccaaacctttttaaagttctaaattggcaggcagactacttgttcgttcttttgattgttcattaatagcagatgaatcctagggcagatttttaatattttagaaacatattttcatgtatttatgaacattaatcccaagatatttatatgaattttataaggaaggcagtgttacaagat

SEQ ID NO: 30913 - DNA, 320 bp, Homo sapiens
gttttttttttttagaagaaataaaaaaatttcagtgttaatgactgtttacattttcgtgaattctttccaatatttgatatttatacatatataataaaattatatctacctacctatctgtctacctatctatctgctttctagtctccctttttcttttacttagctcagatcatgaagatttttttccatgtcaataaatatatttcttctcttttctttttcttttcttttttttttttcttttttttgagatggagtctctctctgttgcccaggctggagtgcagtggtgcagtctcagctcactgcaacct

SEQ ID NO: 30914 - DNA, 141 bp, Homo sapiens
tcagcagctgttttacatagaatgactctggttctggtgtgcagggaatatcaaaggtcaccggcatcacaggtcatatgtcctaatgaggaacccgggcccacgggagcagcttgattcttacaggttgtctgggagctg

SEQ ID NO: 30915 - DNA, 548 bp, Homo sapiens
ggggggactttatttagaaacagtttataactcaccaagataatcaattcaaccacacctaagctgacttcaacgatcatttattgtctgccaactatgcacctgtgacatgctggcagtcatattattctatggtcaaatatcacaaaattcacttaagcccaaaaatggattactcttgatgtcttctggccaagaaataaaaggacgcctgagccaccagacttgtcacacctggtaacttaatgtttgacaatgtgtgcacatttggattccttccaaaacaattcttttagcccgatccatcaagaaccctctatttacctttaagctattaaaggtaaagcattaacttgaaacaaaataatgaatcatagaatcttataggaagaagggaatttagagctcacatttcctgttaagaggagacttagatcacataaattctgtaacttgcccaattaaagacatgtcaacaacgttcttttaaaccatggaaatgtcattaagagaactaaaattaaaatgtttgcttgagaaaaagaagt

SEQ ID NO: 30916 - DNA, 268 bp, Homo sapiens
ccctagaagaaaatctaggaaacaccatcctaaacattgaccttgggaaggaacttatgactaattcctcaaaagcaattgcaacaaaaacaaaaattaaccggtgggacctaattaaactaaagagcttctgtatagcaaaagaaactatcaacagagtgaacagacaacctccacaatgggagaaaatattcacaaactatgcatccaacaaaggtctaatatccagaatctaaaaggaacttaagcaatccaattaaaaaaaaaa

SEQ ID NO: 30917 - DNA, 4334 bp, Homo sapiens
cgggcagcgtggaccccggatgagttgcttttaggcttgctggcccgcggggctgtccaggcacgcgaggcccctcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatagctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcatcagacactcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctattcttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatat

SEQ ID NO: 30918 - DNA, 2017 bp, Homo sapiens
cgggcagcgtggaccccggatgagttgcttttaggcttgctggcccgcggggctgtccaggcacgcgaggcccctcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctattcttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatat

SEQ ID NO: 30919 - DNA, 663 bp, Homo sapiens
ctaaatgactgacactgaatagccatcctttcaggagagagtccatttcagacccacaggaagtatgaccttagtctcaagacacctttatcaaaatacaacagttctaatagctgcctaagacttattcagatgaatctttttgttatacaaccacataagcatatggagaaagagaatattttgggaagtacctgtttatgcaacatgttttagcctttcagatagttcctgtggtacacatttggcttgtacactcaaaagatggatgtgaataccactctatcagagtaagttcatgaagcagccctgagagagaataaactagaacccatggggcgtagcgtgaaggacagcctggattgttcctttctcttaataggcttgtaccaactggactgcattttctgtctagttttaggtgaagtagatctttcagaacctgtcctggcccaaacctgaaaatggtcctgaagtcacaatgtctccagaatctaggagtgcctctctgaagtgcttggttgagacggaattttaccatgttgaccaggctgatctggaactcctgacctcagcatgaaaatccttacaagatgccagcaccatgctcttggagttcccggcttccagaactgtggaccaaataaaacactattgtttata

SEQ ID NO: 30920 - DNA, 458 bp, Homo sapiens
atttttttctagaccttaaaatttctaccaacataatgtaataagcaacccaaattttatataactgtttatgtttccaaactattaataattgaagtgacatggtattgtagaaagattattggcctctaaatagaccagggtctgaatcctggctctgcttcccagttgctgcttaaccttaagcatattattttaccactttgagcttgagtttctttaactgaaatagggatgacaatacttagagagttgttatgggaaacagagaacatgcttgcagtattgcagtgtagtaggtgtcgaataggtattaatattcatgatgataggaagcaatataccatagtggttagaagtcagacccagtccattccccaaccccgctgaggcagtaatttgttttctttctctgcttgaattgttgtttcacccttgtccatttcatgacctcttca

SEQ ID NO: 30921 - DNA, 468 bp, Homo sapiens
cacattctcattattgcttgtctgaattaacaggctgttaaataatcttgctgcctctgccagggcagaggcctgtttttgtgctacaggcccctctggcagtctattgaggccgatggtccccttctcagaataatgttttagaatacacaaaagaagatatgtaagattatagaggaaacatttcatacaagtggaattatcaaaatattaacaacaaacttttggtctagtattatatgtgcttctttattagtttaggaaaatggaaatcttttccaaaagtctgctagccaacttaccctcccatctcataatggcagatgactagttgttctttcaaaatccattctgcccattttctggggcatatagctgataagctagacactccgttttctgtacttcttgcagttaaatgtggtcatgtgactgtgctatcactaatataaaattcaatggaacatg

SEQ ID NO: 30922 - DNA, 285 bp, Homo sapiens
gataaacatcaaatacatatagcattcagaaataacgtttaataggtacttcataccaaatcgacaaacatgggctggagtggcaatcacttgcagaggtttaaacttcagtttcaaatttgtcctatttcacaagagtcttcctctatctcaacatacttcttatttttatagaagaagttaactacatatgaccatttttggcaaagacagatgaaaactaactctgaggctaaaattgattcaaaatgacagtagacttagctgtataaaagagagtggaaa

SEQ ID NO: 30923 - DNA, 94 bp, Homo sapiens
gaaggcactcatttgtttcctgtaaagcttgtaatatgcattatttattgtacggagagagcaaaaagggctttcttattcacgtgacaaattc

SEQ ID NO: 30924 - DNA, 767 bp, Homo sapiens
atctaacaagaagatgttacaaacataaatttatgtgcacctaacacaggagtgccaagattcataaaacatttactactgaatctaagaaatgagacaggcagcaacacaataatagtggtggacttcaccactctactgacagctctagacagatcatcgagacagaaagtcaacaaagaaataatggacttgaactacactctgtaataatgaacaaaacagatatttacagaacattctaccccaaaactgcagaatatacatttttctcatcaactcatgaaagtttctccaaggcagaccatatgatcagtcaaaaaaagtctcaataagtttaaaaatatcaaaattatataaagtttctttgcagaccacagtggaataaaactagaaatcttctacaaaaggaaccttcaaaactgtacaaataaatggaaggtaaacaatcctcctcaataatttttgtgttaactatgaaatcaagatgaaaatttaataaactattggaaataaatgataataataacacaagtaatcaaactctgggatacagcaaaagcagtgcaaagagaaaagtttgtagcactaaatgccaacctcaaaaagtctggaaaacaacaaattgacaactgaatgtcacacctcaaggaactagagaaacaataagaaactaaacccaaagttaacagcagaaaataaatagcaaaaatcagagcacaaaaaaaatgaaattgaaagaaacaaaccaaaaaaaaaaaaaaaac

SEQ ID NO: 30925 - DNA, 414 bp, Homo sapiens
gaaagaaattccctggtttagatgatacaatttctgattgactcttggaaatttacagaggtcttattgcataagtagataagttactgtttaacaattataaggtgttagagataactctcatttgaaggacttttaatgtcaaatagttcacagaagaggagaaatgtattgcctcctctcacccttaaacacacacctgcaaacgtatatgaaactttgctagtaacacagagaggacaaagtatttctggccataatagatttgtatgaagagtagaggagatttatgtattagaatacaacaaagaaggaagagatgtctggaagtgcaaaagcatttatcgtggttccctgcagccatactaacagtagcttgaaaacaaatactgggccaggcatggtggctcatac

SEQ ID NO: 30926 - DNA, 770 bp, Homo sapiens
  misc_feature (20)..(20): n is a, c, g, or t
  misc_feature (70)..(70): n is a, c, g, or t
  misc_feature (85)..(85): n is a, c, g, or t
  misc_feature (88)..(88): n is a, c, g, or t
  misc_feature (97)..(97): n is a, c, g, or t
  misc_feature (99)..(99): n is a, c, g, or t
  misc_feature (126)..(126): n is a, c, g, or t
  misc_feature (134)..(134): n is a, c, g, or t
  misc_feature (769)..(769): n is a, c, g, or t
taaattggaattttcagatnaaacattcggatcaaatattccaaagcagtttgtgcctgctgtagaaaangggtttttagatgcntgngagaaaggncntctttctggtcacaagctctctgggcnccggtttntcctgcaagatggagcacaccacatggttgattctaatgaaatctctttcatcccgagcaggagaaggtggctcttaaacaacggccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcctctgttatattcaaaggtaattctatgtctatctcaana

SEQ ID NO: 30927 - DNA, 797 bp, Homo sapiens
  misc_feature (20)..(20): n is a, c, g, or t
  misc_feature (70)..(70): n is a, c, g, or t
  misc_feature (85)..(85): n is a, c, g, or t
  misc_feature (88)..(88): n is a, c, g, or t
  misc_feature (97)..(97): n is a, c, g, or t
  misc_feature (99)..(99): n is a, c, g, or t
  misc_feature (126)..(126): n is a, c, g, or t
  misc_feature (134)..(134): n is a, c, g, or t
taaattggaattttcagatnaaacattcggatcaaatattccaaagcagtttgtgcctgctgtagaaaangggtttttagatgcntgngagaaaggncntctttctggtcacaagctctctgggcnccggtttntcctgcaagatggagcacaccacatggttgattctaatgaaatctctttcatcccgagcaggagaaggtggctcttaaacaacggccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtaagtagtcttggtcattggcagtcctgcttttattaaccatagaaggaaatccaggttagcttttgtttttgcaaatggacacatttccttgctgaatttgtggctttatacatgtggcattttctgtaatttgctattaaagcaactcttaagtgcagaagttaaaaataagatttattttatcttgaccttttgtgaatgtgtcattttcttagatgtaccttatctccttctttattgaatagcacagatggacaaattaaaaagaaaaggaaaaataaaataagatgtatattatctctctcattttagctttatttgcataattactttattgttatctttaatttatccctcttaattaccttgcctgtacctttcttgacttaaatctcaataaagaaggaaaataat

SEQ ID NO: 30928 - DNA, 769 bp, Homo sapiens
  misc_feature (20)..(20): n is a, c, g, or t
  misc_feature (70)..(70): n is a, c, g, or t
  misc_feature (85)..(85): n is a, c, g, or t
  misc_feature (88)..(88): n is a, c, g, or t
  misc_feature (97)..(97): n is a, c, g, or t
  misc_feature (99)..(99): n is a, c, g, or t
  misc_feature (126)..(126): n is a, c, g, or t
  misc_feature (134)..(134): n is a, c, g, or t
taaattggaattttcagatnaaacattcggatcaaatattccaaagcagtttgtgcctgctgtagaaaangggtttttagatgcntgngagaaaggncntctttctggtcacaagctctctgggcnccggtttntcctgcaagatggagcacaccacatggttgattctaatgaaatctctttcatcccgagcaggagaaggtggctcttaaacaacggccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtaagtagtcttggtcattggcagtcctgcttttattaaccatagaaggaaatccaggttagcttttgtttttgcaaatggacacatttccttgctgaatttgtggctttatacatgtggcattttctgtaatttgctattaaagcaactcttaagtgcagaagttaaaaataagatttattttatcttgaccttttgtgaatgtgtcattttcttagatgtaccttatctccttctttattgaatagcacagatggacaaattaaaaagaaaaggaaaaataaaataagatgtatattatctctctcattttagctttatttgcataattactttattgttatctttaattctgagcccatatttcacttaccttatttaaaataaat

SEQ ID NO: 30929 - DNA, 252 bp, Homo sapiens
tccctctaaatgatatgtttggttattccactgaacttaggtcatgcacagaggtaggcaaatttaaacttacccttcaaaagaccaccctacagaatgatcatattataaaatcttgaccttgtatgacttttacttgatagtttaaaaaacaaacaaacaaacaaaaaaccctctcttttttttaaatccctagggaaagggagaatacacaatggagtatagcaggtatcagccatgtttaccatccac

SEQ ID NO: 30930 - DNA, 468 bp, Homo sapiens
atctccttttgcagtttcaaaaaagattatcatttgaggcgattgttcctgatctttatggcactgaagaattgaagcactaggaccaaataacagaaattacagaaaacaagatctcggctcaaatgtgaaagactttcctcacactattctgagatctaataggaagccctagaaggtgttcaaacgtgagtcaaacaaatacctaatgtagaggttgtatttaaggtgcaagcaccagagtgatgttgaaatgaatgagatttaaaatattttccaatccaaagtctataagactccatgattttgtgaaatgaaaatttctcttgtactcacagaaaggatcattaaagtctttttcattgaaaaaggcatacagttttctagcttccttttgaattctagttaatgtattttaggccatggttgccagcctactccctataaatagttacataatgcaaaaaa

SEQ ID NO: 30931 - DNA, 4509 bp, Homo sapiens
gtgttgcaagggatatattttattagtttcattaatgaaattttaatagcaataaattcaggcttttaaatattacaaagtattttcaaatatctcatggggccttgatgttagcttcaggaagtatctagcaacctaatggctgtttgattagacttctcagactattattatccttgtcacataatagtgctttagtccatgtatcataggatcttcaagtattattcatttgtttccaaagcaaattgagctattccactcaaatgattacagtaaatagaatagaaacttgtggaatcatcttcctctctcgtaaatgaagtaacagcaaaatagcgcagcatctcagctgttccaggttcctcaaataagttttacttttgcaaaaccaacctcaaacttcctatattctctgttctgcattataagcaacatgaccagcagccacgtttgttgtaattttttaaatatgtggaaaaaaagcaagatatcaaccatgtattaccttaaccaagatgccaaattatctaacttgtttctccaggcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcaatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattatgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatacaaatatttaacttcccagtagccctattttaaaaagtaaaaataaatgtttgtttgttaaaatgaattttgattttttaaaaacactatatgttatttcaacgtcatcaatataaaaaattgattgattgattgatagtttacatctgtttcttgaaccaagttttcaaaatccagttggtaatttaaaagtacacttcacttcaacttgaattaactatattggatagcacagccgtaaaattagagactaagcttctgctttatttaacagttgttgagtatttcaaaacagtttaattcattcttttatttcaaagtctcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatgcatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgacttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaagggaaaaaaaaaacaaacctttaaatgaggagaaagatggtataaatattagtagtggctgacactgagtccagatagtcttgattcctagaaataaacaaaaggtaaacaatgtcaattttgtgtgtgtgtatggcgtgtgtgtagtcatgtatatatgcggggaaaatgttaaggtattcagtcaggaaacaaaaggtttaaaactcatctttcttaaaacttgttataagcacagggaaagcaaagttgaggtaactaaactgaaccaaaaattctgtataaataaggatataagtaattaacgttttaaaaaacatgtggaccttaaacaaactgtatattaaattcctcttaaatgcccattttaaatatttaagataaatacatttatgaataacaaatctgtgggtgatttaaccatggcaccatatccaagggattaaccttaatgcaattttcctgttaattgtcctaagctttttactaatccattttccctgtgggttagtaatggcaacatgctgcttacagatattcccggggaaaaacatccagacaccagcaaacaaagaaatgttgatttctcttttgtttgctctgaaagtaaaataattatttactttaattaacatggaaaatattgtttaaattctgtacgaacctaaacaagatacgttgcagggctgatttcacagtggaggatgatcggctaaaataaagcctcatttattaagggctacacttttaacactaagaaaacatttctagaataaaaagcaaaggtaagcattattctattaatagtaaaagaggacatgggattttaaaactatacctaaattcttgcaattaacttttatgggcttggacattgttgaaatgagaaaataatataatatagcttcctggcaggttaaaagtcaacacttgattttgctattcttctgactttttgaaaccctgaagttctgaatttcaagcttttaagaagcttttcagcaatggttgtttgtttatggttcaaacatctgaaataactacctgcatttaaaatctaatgttgattattttctttttacattctgtgtggcaatggagcatttgccctttcaaacagtaaaacgatttagctttgtggcagtgcttttttgtagactgactgactatacccttcaaaaagaaaaactgctctacggaatgcaaattttgaggcatgtttacctgctcgtggaagaaataaaatggaattgaaaaaaaaaggactaaaattgaagaatgaaattacagttgtgttaaaaaccttggctctttataatcatgaatcttcagtattaaaccagacattgatgctgttaatttttttaaagaactatcactcttatcgtacaggagtaaagattaaattgtaaaagaaagaaattccaattttttaaaaagtaaagcccaaaaggcaattaagcttaagt

SEQ ID NO: 30932 - DNA, 4415 bp, Homo sapiens
gtgttgcaagggatatattttattagtttcattaatgaaattttaatagcaataaattcaggcttttaaatattacaaagtattttcaaatatctcatggggccttgatgttagcttcaggaagtatctagcaacctaatggctgtttgattagacttctcagactattattatccttgtcacataatagtgctttagtccatgtatcataggatcttcaagtattattcatttgtttccaaagcaaattgagctattccactcaaatgattacagtaaatagaatagaaacttgtggaatcatcttcctctctcgtaaatgaagtaacagcaaaatagcgcagcatctcagctgttccaggttcctcaaataagttttacttttgcaaaaccaacctcaaacttcctatattctctgttctgcattataagcaacatgaccagcagccacgtttgttgtaattttttaaatatgtggaaaaaaagcaagatatcaaccatgtattaccttaaccaagatgccaaattatctaacttgtttctccaggcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcaatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattatgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatacaaatatttaacttcccagtagccctattttaaaaagtaaaaataaatgtttgtttgttaaaatgaattttgattttttaaaaacactatatgttatttcaacgtcatcaatataaaaaattgattgattgattgatagtttacatctgtttcttgaaccaagttttcaaaatccagttggtaatttaaaagtacacttcacttcaacttgaattaactatattggatagcacagccgtaaaattagagactaagcttctgctttatttaacagttgttgagtatttcaaaacagtttaattcattcttttatttcaaagtctcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatgcatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgacttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaagggaaaaaaaaaacaaacctttaaatgaggagaaagatggtataaatattagtagtggctgacactgagtccagatagtcttgattcctagaaataaacaaaaggtttaaaactcatctttcttaaaacttgttataagcacagggaaagcaaagttgaggtaactaaactgaaccaaaaattctgtataaataaggatataagtaattaacgttttaaaaaacatgtggaccttaaacaaactgtatattaaattcctcttaaatgcccattttaaatatttaagataaatacatttatgaataacaaatctgtgggtgatttaaccatggcaccatatccaagggattaaccttaatgcaattttcctgttaattgtcctaagctttttactaatccattttccctgtgggttagtaatggcaacatgctgcttacagatattcccggggaaaaacatccagacaccagcaaacaaagaaatgttgatttctcttttgtttgctctgaaagtaaaataattatttactttaattaacatggaaaatattgtttaaattctgtacgaacctaaacaagatacgttgcagggctgatttcacagtggaggatgatcggctaaaataaagcctcatttattaagggctacacttttaacactaagaaaacatttctagaataaaaagcaaaggtaagcattattctattaatagtaaaagaggacatgggattttaaaactatacctaaattcttgcaattaacttttatgggcttggacattgttgaaatgagaaaataatataatatagcttcctggcaggttaaaagtcaacacttgattttgctattcttctgactttttgaaaccctgaagttctgaatttcaagcttttaagaagcttttcagcaatggttgtttgtttatggttcaaacatctgaaataactacctgcatttaaaatctaatgttgattattttctttttacattctgtgtggcaatggagcatttgccctttcaaacagtaaaacgatttagctttgtggcagtgcttttttgtagactgactgactatacccttcaaaaagaaaaactgctctacggaatgcaaattttgaggcatgtttacctgctcgtggaagaaataaaatggaattgaaaaaaaaaggactaaaattgaagaatgaaattacagttgtgttaaaaaccttggctctttataatcatgaatcttcagtattaaaccagacattgatgctgttaatttttttaaagaactatcactcttatcgtacaggagtaaagattaaattgtaaaagaaagaaattccaattttttaaaaagtaaagcccaaaaggcaattaagcttaagt

SEQ ID NO: 30933 - DNA, 4450 bp, Homo sapiens
gtgttgcaagggatatattttattagtttcattaatgaaattttaatagcaataaattcaggcttttaaatattacaaagtattttcaaatatctcatggggccttgatgttagcttcaggaagtatctagcaacctaatggctgtttgattagacttctcagactattattatccttgtcacataatagtgctttagtccatgtatcataggatcttcaagtattattcatttgtttccaaagcaaattgagctattccactcaaatgattacagtaaatagaatagaaacttgtggaatcatcttcctctctcgtaaatgaagtaacagcaaaatagcgcagcatctcagctgttccaggttcctcaaataagttttacttttgcaaaaccaacctcaaacttcctatattctctgttctgcattataagcaacatgaccagcagccacgtttgttgtaattttttaaatatgtggaaaaaaagcaagatatcaaccatgtattaccttaaccaagatgccaaattatctaacttgtttctccaggcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggattgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattatgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatacaaatatttaacttcccagtagccctattttaaaaagtaaaaataaatgtttgtttgttaaaatgaattttgattttttaaaaacactatatgttatttcaacgtcatcaatataaaaaattgattgattgattgatagtttacatctgtttcttgaaccaagttttcaaaatccagttggtaatttaaaagtacacttcacttcaacttgaattaactatattggatagcacagccgtaaaattagagactaagcttctgctttatttaacagttgttgagtatttcaaaacagtttaattcattcttttatttcaaagtctcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatgcatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgacttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaagggaaaaaaaaaacaaacctttaaatgaggagaaagatggtataaatattagtagtggctgacactgagtccagatagtcttgattcctagaaataaacaaaaggtaaacaatgtcaattttgtgtgtgtgtatggcgtgtgtgtagtcatgtatatatgcggggaaaatgttaaggtattcagtcaggaaacaaaaggtttaaaactcatctttcttaaaacttgttataagcacagggaaagcaaagttgaggtaactaaactgaaccaaaaattctgtataaataaggatataagtaattaacgttttaaaaaacatgtggaccttaaacaaactgtatattaaattcctcttaaatgcccattttaaatatttaagataaatacatttatgaataacaaatctgtgggtgatttaaccatggcaccatatccaagggattaaccttaatgcaattttcctgttaattgtcctaagctttttactaatccattttccctgtgggttagtaatggcaacatgctgcttacagatattcccggggaaaaacatccagacaccagcaaacaaagaaatgttgatttctcttttgtttgctctgaaagtaaaataattatttactttaattaacatggaaaatattgtttaaattctgtacgaacctaaacaagatacgttgcagggctgatttcacagtggaggatgatcggctaaaataaagcctcatttattaagggctacacttttaacactaagaaaacatttctagaataaaaagcaaaggtaagcattattctattaatagtaaaagaggacatgggattttaaaactatacctaaattcttgcaattaacttttatgggcttggacattgttgaaatgagaaaataatataatatagcttcctggcaggttaaaagtcaacacttgattttgctattcttctgactttttgaaaccctgaagttctgaatttcaagcttttaagaagcttttcagcaatggttgtttgtttatggttcaaacatctgaaataactacctgcatttaaaatctaatgttgattattttctttttacattctgtgtggcaatggagcatttgccctttcaaacagtaaaacgatttagctttgtggcagtgcttttttgtagactgactgactatacccttcaaaaagaaaaactgctctacggaatgcaaattttgaggcatgtttacctgctcgtggaagaaataaaatggaattgaaaaaaaaaggactaaaattgaagaatgaaattacagttgtgttaaaaaccttggctctttataatcatgaatcttcagtattaaaccagacattgatgctgttaatttttttaaagaactatcactcttatcgtacaggagtaaagattaaattgtaaaagaaagaaattccaattttttaaaaagtaaagcccaaaaggcaattaagcttaagt

SEQ ID NO: 30934 - DNA, 4866 bp, Homo sapiens
aatgagcctgtttctgagggtgttagaaaccttgtatctagatgccagctgctgctacagggggggattgcaactaactcccaggaatgaaaaatccccagggcgatctgcaagtcgatcaagtaacatttcaaaagcaagcagcccaacaacagggacagctcccaggagccagtcaaggttgtctgtctgtccatccactcaggacatctgcagatctgccatcttgcatgacatgtcagaagagtcatttgagtattgcacccctgtcatggtgctgagccctgctaggaaggagtctggtaagaaatcagtaatacaaagacctaggaggaggagaaaagcctctgagagatatgagcatgctgcagaagaacaaataagagggagaaaaaatgactttcaccttcaaatctcaagccccaggtggagggagctttacacagattcttcagattcatcttccacagatgagagtcattggattcaggcaaaaagaagagcccaggttaaattcagactgtcaagaagaaggaggagaaataataataagccgtgtgaaaacttagctgggtcttccactcctaacggaattgagctcgttgatctgggatccaaaggtaaagagcaacaagagctgattgaatgtgagagttgctctttaaatctccacagaggaaaacatacaaggtaccaagaatgcaacccttctctgactcaagggtcctctgaaattaagagatcctcaaggaatcatgagaagagcaaaggcagatatcaccacagagatcctcagctcttgcaaagtcttaggaaaaatgaaataatgaagaagacattttcagaaacagattccagcactgaaatactgggagttccagaaggcagcaaggacatgaatgatgcagggctccaggtgaataaccctgttcagaagcctcctgccacctatgacgatgggtctgataatttagaagtatgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcaatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattatgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatacaaatatttaacttcccagtagccctattttaaaaagtaaaaataaatgtttgtttgttaaaatgaattttgattttttaaaaacactatatgttatttcaacgtcatcaatataaaaaattgattgattgattgatagtttacatctgtttcttgaaccaagttttcaaaatccagttggtaatttaaaagtacacttcacttcaacttgaattaactatattggatagcacagccgtaaaattagagactaagcttctgctttatttaacagttgttgagtatttcaaaacagtttaattcattcttttatttcaaagtctcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatgcatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgacttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaagggaaaaaaaaaacaaacctttaaatgaggagaaagatggtataaatattagtagtggctgacactgagtccagatagtcttgattcctagaaataaacaaaaggtaaacaatgtcaattttgtgtgtgtgtatggcgtgtgtgtagtcatgtatatatgcggggaaaatgttaaggtattcagtcaggaaacaaaaggtttaaaactcatctttcttaaaacttgttataagcacagggaaagcaaagttgaggtaactaaactgaaccaaaaattctgtataaataaggatataagtaattaacgttttaaaaaacatgtggaccttaaacaaactgtatattaaattcctcttaaatgcccattttaaatatttaagataaatacatttatgaataacaaatctgtgggtgatttaaccatggcaccatatccaagggattaaccttaatgcaattttcctgttaattgtcctaagctttttactaatccattttccctgtgggttagtaatggcaacatgctgcttacagatattcccggggaaaaacatccagacaccagcaaacaaagaaatgttgatttctcttttgtttgctctgaaagtaaaataattatttactttaattaacatggaaaatattgtttaaattctgtacgaacctaaacaagatacgttgcagggctgatttcacagtggaggatgatcggctaaaataaagcctcatttattaagggctacacttttaacactaagaaaacatttctagaataaaaagcaaaggtaagcattattctattaatagtaaaagaggacatgggattttaaaactatacctaaattcttgcaattaacttttatgggcttggacattgttgaaatgagaaaataatataatatagcttcctggcaggttaaaagtcaacacttgattttgctattcttctgactttttgaaaccctgaagttctgaatttcaagcttttaagaagcttttcagcaatggttgtttgtttatggttcaaacatctgaaataactacctgcatttaaaatctaatgttgattattttctttttacattctgtgtggcaatggagcatttgccctttcaaacagtaaaacgatttagctttgtggcagtgcttttttgtagactgactgactatacccttcaaaaagaaaaactgctctacggaatgcaaattttgaggcatgtttacctgctcgtggaagaaataaaatggaattgaaaaaaaaaggactaaaattgaagaatgaaattacagttgtgttaaaaaccttggctctttataatcatgaatcttcagtattaaaccagacattgatgctgttaatttttttaaagaactatcactcttatcgtacaggagtaaagattaaattgtaaaagaaagaaattccaattttttaaaaagtaaagcccaaaaggcaattaagcttaagt

SEQ ID NO: 30935 - DNA, 4055 bp, Homo sapiens
gtgttgcaagggatatattttattagtttcattaatgaaattttaatagcaataaattcaggcttttaaatattacaaagtattttcaaatatctcatggggccttgatgttagcttcaggaagtatctagcaacctaatggctgtttgattagacttctcagactattattatccttgtcacataatagtgctttagtccatgtatcataggatcttcaagtattattcatttgtttccaaagcaaattgagctattccactcaaatgattacagtaaatagaatagaaacttgtggaatcatcttcctctctcgtaaatgaagtaacagcaaaatagcgcagcatctcagctgttccaggttcctcaaataagttttacttttgcaaaaccaacctcaaacttcctatattctctgttctgcattataagcaacatgaccagcagccacgtttgttgtaattttttaaatatgtggaaaaaaagcaagatatcaaccatttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagatatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattatgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatacaaatatttaacttcccagtagccctattttaaaaagtaaaaataaatgtttgtttgttaaaatgaattttgattttttaaaaacactatatgttatttcaacgtcatcaatataaaaaattgattgattgattgatagtttacatctgtttcttgaaccaagttttcaaaatccagttggtaatttaaaagtacacttcacttcaacttgaattaactatattggatagcacagccgtaaaattagagactaagcttctgctttatttaacagttgttgagtatttcaaaacagtttaattcattcttttatttcaaagtctcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatgcatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgacttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaagggaaaaaaaaaacaaacctttaaatgaggagaaagatggtataaatattagtagtggctgacactgagtccagatagtcttgattcctagaaataaacaaaaggtaaacaatgtcaattttgtgtgtgtgtatggcgtgtgtgtagtcatgtatatatgcggggaaaatgttaaggtattcagtcaggaaacaaaaggtttaaaactcatctttcttaaaacttgttataagcacagggaaagcaaagttgaggtaactaaactgaaccaaaaattctgtataaataaggatataagtaattaacgttttaaaaaacatgtggaccttaaacaaactgtatattaaattcctcttaaatgcccattttaaatatttaagataaatacatttatgaataacaaatctgtgggtgatttaaccatggcaccatatccaagggattaaccttaatgcaattttcctgttaattgtcctaagctttttactaatccattttccctgtgggttagtaatggcaacatgctgcttacagatattcccggggaaaaacatccagacaccagcaaacaaagaaatgttgatttctcttttgtttgctctgaaagtaaaataattatttactttaattaacatggaaaatattgtttaaattctgtacgaacctaaacaagatacgttgcagggctgatttcacagtggaggatgatcggctaaaataaagcctcatttattaagggctacacttttaacactaagaaaacatttctagaataaaaagcaaaggtaagcattattctattaatagtaaaagaggacatgggattttaaaactatacctaaattcttgcaattaacttttatgggcttggacattgttgaaatgagaaaataatataatatagcttcctggcaggttaaaagtcaacacttgattttgctattcttctgactttttgaaaccctgaagttctgaatttcaagcttttaagaagcttttcagcaatggttgtttgtttatggttcaaacatctgaaataactacctgcatttaaaatctaatgttgattattttctttttacattctgtgtggcaatggagcatttgccctttcaaacagtaaaacgatttagctttgtggcagtgcttttttgtagactgactgactatacccttcaaaaagaaaaactgctctacggaatgcaaattttgaggcatgtttacctgctcgtggaagaaataaaatggaattgaaaaaaaaaggactaaaattgaagaatgaaattacagttgtgttaaaaaccttggctctttataatcatgaatcttcagtattaaaccagacattgatgctgttaatttttttaaagaactatcactcttatcgtacaggagtaaagattaaattgtaaaagaaagaaattccaattttttaaaaagtaaagcccaaaaggcaattaagcttaagt

SEQ ID NO: 30936 - DNA, 3246 bp, Homo sapiens
  misc_feature (1491)..(1491): n is a, c, g, or t
  misc_feature (2112)..(2112): n is a, c, g, or t
  misc_feature (2231)..(2231): n is a, c, g, or t
aatgagcctgtttctgagggtgttagaaaccttgtatctagatgccagctgctgctacagggggggattgcaactaactcccaggaatgaaaaatccccagggcgatctgcaagtcgatcaagtaacatttcaaaagcaagcagcccaacaacagggacagctcccaggagccagtcaaggttgtctgtctgtccatccactcaggacatctgcagatctgccatcttgcatgacatgtcagaagagtcatttgagtattgcacccctgtcatggtgctgagccctgctaggaaggagtctggtaagaaatcagtaatacaaagacctaggaggaggagaaaagcctctgagagatatgagcatgctgcagaagaacaaataagagggagaaaaaatgactttcaccttcaaatctcaagccccaggtggagggagctttacacagattcttcagattcatcttccacagatgagagtcattggattcaggcaaaaagaagagcccaggttaaattcagactgtcaagaagaaggaggagaaataataataagccgtgtgaaaacttagctgggtcttccactcctaacggaattgagctcgttgatctgggatccaaaggtaaagagcaacaagagctgattgaatgtgagagttgctctttaaatctccacagaggaaaacatacaaggtaccaagaatgcaacccttctctgactcaagggtcctctgaaattaagagatcctcaaggaatcatgagaagagcaaaggcagatatcaccacagagatcctcagctcttgcaaagtcttaggaaaaatgaaataatgaagaagacattttcagaaacagattccagcactgaaatactgggagttccagaaggcagcaaggacatgaatgatgcagggctccaggtgaataaccctgttcagaagcctcctgccacctatgacgatgggtctgataatttagaagtatgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaaggtacagtatccataggaattggtttgggagggaccatttgcaaagcagacttgttttagaaatctatttcctttgccaatacgattctcctaatatgctaatatccattaagggtatgtgtcttgtgttgagctcagtgcacaaaatttatctaagtgtttgcagataatccttcctttcttctatgttttatattctagagcttctgattgatatattactttcaatgcttttttaaaagtcagtgtgtgcacgtaatagatataaacatatatatgtatatgcatgcaaaatgcacttgtaattcaatgtaattgaattgatgngaactatgatagcattgtgcttacggaagccagttctcaagaaggttacatgatacattgccttaaacaacatcaactcatcaaatttcttacaagttatttattaggtaatagaagagaatgatttcttctataaagtgtgtactatttatgtttgcttttatttgggaattggtttaatggcacatgtgtaattagagtaggtagaaataaaaagtactattttccatattgtgcatcaggctgtaagagagaggtaagtgtattttgtatctgtaatgtttgtcttcaaattcctcatttatgttatatttttctgaagaagaaaggtaagactgtgagtcagatacaaagttagtgtctcactcaaagccaccgaagaacagcttgtaaacaatacaaacaaggacaatgaacttatacaattcatgtttgatagctggacttctggattttagcatgtaacttatttatctttttgcctaactgtagccttacatatatggctgcctcagtttccaagggagagtatgaagaccacagtttaaataatgaatcatcccagagttgctttttttatttaaattgaatgcaaagcaaaagttataggacattgcctgnaaagaaacacaacgagttccagaatgagcagagttgaaatgcaaataagaatattctagcacatatctgattgctggctgaccattgcaattcttcattaattctgtaaattgtggagngagagaatcacattccttgcttttgtggtagcctcaatttttaaaatctgcaaatggtttatagctatcaaaaataatgcataaaattcctttaggatatgtgtggtctttttttaacaatggggtaacctgagtgctgcagggtaaccctgtttttctagggcccagaggtgtcaatgccagaaatagaaatggaccctgattccttgtcctttgcttcatccgctggacagatgctgagcattgtctgcagtagttaaatggcacattgtactccacgattttccaaatgttttttcttagttctcagggcactacaaattatttcatagaatctatatatttcttcattttttttctcatgctaaatttacataaaattttcatttcaactttgtcaaatacagtattttaatttgagggccacgatctaggataataacatattctaattttctcttctttaccatatctatcaccactactcatttttgtttaattaaaaaacatgatgctgagaagaaacttgaaaagtctttttattccaccgccagcttttgtagtatctagtataccctgtcaatacaactttcatcctttgttaatattccattctcaataatttacaactctcttaggaaatcttatttttttcctcaacaaacacacttataaaccagagaaaggcagcaaatatgtctatctttttaaatattcatgataatggaccaggcacggtggcttacacctggaatctcagcactttgggaggctgaggcaggcgtatcccttgagcccaggagtttgagaccaacctgggcaacaaagtgaaatcttgtctctacaaaaaagttaaaaaaaaaaattaacctggcatggtagcacacacctgtagttccagctactcaagaggctgaggaaggaggatcccttgagcctaggatttcaaggttccagtgagctttgattgcaccactgcaatcaagcctgagtgacagagccatactttgtctcc

SEQ ID NO: 30937 - DNA, 1859 bp, Homo sapiens
gtgttgcaagggatatattttattagtttcattaatgaaattttaatagcaataaattcaggcttttaaatattacaaagtattttcaaatatctcatggggccttgatgttagcttcaggaagtatctagcaacctaatggctgtttgattagacttctcagactattattatccttgtcacataatagtgctttagtccatgtatcataggatcttcaagtattattcatttgtttccaaagcaaattgagctattccactcaaatgattacagtaaatagaatagaaacttgtggaatcatcttcctctctcgtaaatgaagtaacagcaaaatagcgcagcatctcagctgttccaggttcctcaaataagttttacttttgcaaaaccaacctcaaacttcctatattctctgttctgcattataagcaacatgaccagcagccacgtttgttgtaattttttaaatatgtggaaaaaaagcaagatatcaaccatgtattaccttaaccaagatgccaaattatctaacttgtttctccaggcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcaatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttga

SEQ ID NO: 30938 - DNA, 313 bp, Homo sapiens
ttttatttgtggctattgcaaataggattacttttttgaattcttttccagtttgttgactgttggcatatagaaatcctactgatttgtacatgttgattttgtattatgcaaatttactcaagttattacttctaatagttttttgatggatatattaggccattctcatattgctgtaaaaataatcagtgactagttaatttataaaggaaataggtttcattgcctcatggttctacaggctgtacagaaagcatagcactggcttctgcttctggtgaagcctctgacaactgacaatcaaggtgaa

SEQ ID NO: 30939 - DNA, 476 bp, Homo sapiens
atcgtggaaaaattgtcttccacgaaactgctccttggtgctaaaaaggttggggaccactgctttgtagtttataaaaacacttttatatgttccattttctttgattcttaggccaaaccagaaagacatttaggacaaagaagacatttgctattcatatgaatactctaagaattctgaggcccaagggccggggcactacggttcatgcttgtaatcccagcactttgggaggctgagacaggaggattgctagagctcaggagtttgacaccagcctgggcaatgtggcaaaaccgtctctacacaaaatataaaaattagccaggcatgcactacaggtgcacacctgtcatcccagctactcaggaggctgaggtgggaggattgcatgagcccaggaggtcgagactgcagtgagctgtgatcatcccactgcacttcagcctgagtgacagagcaagaccctgttt

SEQ ID NO: 30940 - DNA, 377 bp, Homo sapiens
gtggcaagtaaaagaaggaaactcaagtcaattaacgtgagtttatatcctgcctccaccattcttgagccttgtgaccttgagcagtttgcttaaccatcctgggcctcaatctcctcatcagttacatgaggtaatatgatacatacctcatgatgctaatttggggaaccagtgagttaatacatgaaaagtatttagaacagcaccacacatgaagttagttatcagtatgcctgttggaattttgcataaaaggaagtccacctgagtatacatggtaccggaggcctgctgtttgagagcgcctgctgcctgccggggcttcacagggccttgctggagggaggccagggcttggcttgcagctctggaga

SEQ ID NO: 30941 - DNA, 799 bp, Homo sapiens
gcctaggcctcccaaagtgttgggattataggtatgagccaccgcgcctggtctgggaaggtaattgattctggagccacacagctccccacccatgtaatgagagccctggctttgagctaagatagagtccctgccccactgccaccaccaagaagcataccagggggccatggttctgtcccatgtgtgttagatgacgtgccacctcctcaggaaaattaccccagccgctcaggaccattcagtcccaggcatgctggagggacttggggacattgggctacaaaggaccctaactgtgggactcaggggtggcaccctgcagcatctccttttcagagcccctcgcagtgaagtcctgccttgtttcaggtgggaaggaggccccagtactggtccttggtcatgtgtagaagttctacgtgtgatctttgattgccagacggaagggtgagatagaaaatcatagttcttttatgactctataagcttgttcaacagttgaatcattgtaatttaattttattttacaagcagtagaaagactcactgggattgaaaactgtgtatcatctccctaggagatgacctaacaaataactgtgatgctattttcaaaggcatttacggccgctctgcagcctcctgtagacaggctgacaggcggcggcagcccagcgtggctgcgcggggcaggagtgcttgtcagcaggaatgctgctcccgccatcgtgacctagagaaccactgttgacatccctgtctttctgccttttatgcaaacattttattcttt

SEQ ID NO: 30942 - DNA, 782 bp, Homo sapiens
tcatttaatcctccacagaaaacctacttttagaacttaggaaactgaggatgaagtgacttgaccaaggtctcctagctacttagcagaggaatactctttagagataaataattgtggtgacatttcaatcaaagtatctgataattgcagtgccttcccacacccaactctctaggagaagaaataatttaaaagatacatttattcataaacacacaagtactcattctgtgtcttttcctatcacaaagcccacggatatacagctgaataagtctgcaagtcagaggttaagaaaagttggctctggcatccgacaggctgacttggatgaggctctgcaatgctaccttggatgggtacttattttctctaacctcagtttcttcatctgcaaaatgggaaacaatattcgtgctttcctcatgattttgctgggaaaatgaaataagacaatatgtttttgcacagtacagtgcattaaacgctccatagtatgcacttgatatatactaggttttattgttgaataagcaaggacagccatggctcctctcagaggagctccctgattagggagaggagaaaaacgtttaaatagcatttcctgtccaatgtgatgcgagcagtagggaaaccagggaaaggcacgaatgactgccttggaaaagtctaaaaaggtttcatagaggtgacttttgagctggtgattttagggggagcagtgcttcaccggatggagaaggaggtagacattccggctatgtccaaacgtgggg

SEQ ID NO: 30943 - DNA, 4723 bp, Homo sapiens
agccagaggaggaggagaactcaggcagctctgcagagggggccaggagctcgggtgtttggtacccccagccccaccgctgttgctgctcctgcagcggggacacaggtgaggacgccccgagagagagggggagggggaccaccactagcgctgtcctcatccttccctggtccagcccccacgccctaacccatcctgggatagtccccaggggtcccactggaccttgcccttcccaggcctccttccagggaccccgcaccctccccctgcctatgccaccttctctcctatgcctggctgtggttgcttctcttcctcctgctgccgctgctgctactgccactgcccagtacacaccgccagcccctcggggtgtggtttccccagacctgcccccaacggtgggacccagccttctcccggcgtctcctgccagcttcctgcaaagcccaggagcccccctccctggagacacacccaactccctttcaacaccccacccccctcttaatcccattttggggttaacccccttcctcttatttagtcttcatagatcccctgggtgctctgggattgtgcccaacttcctaacatttgagtcccggcccttggaattccccaggcccctttttcctccctgtagaactcctgagagtgtcgaccaggctttgttggcccgtctagatacccacctcccccagataactctcagcctctcaaaaaataacccagccccctgtctacccctttagataaccccttcccctctccagccctactaggaggctctggcctctcctttcttccccagaactcctgtagagtatagacacccccccgggctattcttggcaactctaggcagtcccaagacacctttcagcctctttacaacctcctggatccacagccacccctcaagatgcaccagctccctttccagatccatgaggggggtctaaccctcttatgcttcccctagaagtcttgagggtgtggacaaccctcctcacctgtctcagcccctctagaacccccacttccaggcactctcagtctctttcaagcacctctggtcccatttctaccctctggatgccccagtctcctctccaccactgcaaaggaattccaggctcttctgccttccctgagactcttgagagtgcagagaattccccacgtgtttcttggcccctctagacgcccccagacacctctcaggcacaggctgactcctttagaatcatctcagtctctctaaaccctccctcagctccttcttggccccatccccacaccccttttctgctcttctccatgtccccaaggcccttctcagtccctcagaacattgcccaggcccctcctaggttctgtaaatgtcccccagactccttcccatctctttagttcttcctcctggttcctcttggcctctctagacacccccagtttccttgtttgggtggctcaaggtgtctccaagcccccaccatcctggagacagccacattctcctaaacgccaccctcactaagtctccctgggcttggggagtggcacgatggcggcaggcctggccacgtggctgccttttgctcgggcagcagcagtgggctggctgcccctggcccagcaacccctgcccccggcaccgggggtgaaggcatctcgaggagatgaggttctggtggtgaacgtgagcggacggcgctttgagacttggaagaatacgctggaccgctacccagacaccttgctgggcagctcggagaaggaattcttctacgatgctgactcaggcgagtacttcttcgatcgcgaccctgacatgttccgccatgtgctgaacttctaccgaacggggcggctgcattgcccacggcaggagtgcatccaggccttcgacgaagagctggctttctacggcctggttcccgagctagtcggtgactgctgccttgaagagtatcgggaccgaaagaaggagaatgccgagcgcctggcagaggatgaggaggcagagcaggccggggacggcccagccctgccagcaggcagctccctgcggcagcggctctggcgggccttcgagaatccacacacgagcaccgcagccctcgttttctactatgtgaccggcttcttcatcgccgtgtcggtcatcgccaatgtggtggagaccatcccatgccgcggctctgcacgcaggtcctcaagggagcagccctgtggcgaacgcttcccacaggcctttttctgcatggacacagcctgtgtactcatattcacaggtgaatacctcctgcggctgtttgccgcccccagccgttgccgcttcctgcggagtgtcatgagcctcatcgacgtggtggccatcctgccctactacattgggcttttggtgcccaagaacgacgatgtctctggcgcctttgtcaccctgcgtgtgttccgggtgtttcgcatcttcaagttctccaggcactcacagggcttgaggattctgggctacacactcaagagctgtgcctctgagctgggctttctcctcttttccctaaccatggccatcatcatctttgccactgtcatgttttatgctgagaagggcacaaacaagaccaactttacaagcatccctgcggccttctggtataccattgtcaccatgaccacgcttggctacggagacatggtgcccagcaccattgctggcaagattttcgggtccatctgctcactcagtggcgtcttggtcattgccctgcctgtgccagtcattgtgtccaactttagccgcatctaccaccagaaccagcgggctgacaagcgccgagcacagcagaaggtgcgcttggcaaggatccgattggcaaagagtggtaccaccaatgccttcctgcagtacaagcagaatgggggccttgaggacagcggcagtggcgaggaacaggctctttgtgtcaggaaccgttctgcctttgaacagcaacatcaccacttgctgcactgtctagagaagacaacgtgccatgagttcacagatgagctcaccttcagtgaagccctgggagccgtctcgccgggtggccgcaccagccgtagcacctctgtgtcttcccagccagtgggacccggaagcctgctgtcttcttgctgccctcgcagggccaagcgccgcgccatccgccttgccaactccactgcctcagtcagccgtggcagcatgcaggagctggacatgctggcagggctgcgcaggagccatgcccctcagagccgctccagcctcaatgccaagccccatgacagccttgacctgaactgcgacagccgggacttcgtggctgccattatcagcatccctacccctcctgccaacaccccagatgagagccaaccttcctcccctggcggcggtggcagggccggcagcaccctcaggaactccagcctgggtaccccttgcctcttccccgagactgtcaagatctcatccctgtgaggggtaggcctgctgattcagagggtcctcttcatttttgggaactcctttccaaagccatatttttgggaggcagagaggggcaggcttgggcaccccttctgccccccccactgagaactatgcaatggagtttcatgaaatggtccacatagtggggaagtagccaggaaatgagaaacttcctcccaccccagacatttttcctggtgggagctgaagcactgggcttccacaggcccctggcctccttgccctagcacactgggactggccccactctcccagctggactcctgcatgctcctccccttgggctctcagatgaaggcaaagctttgatccgacatctgagctctagcctaagaaggagagttgagatttcctcctccctctggctgggatatggagctttggaggttcagagaagagaaccctcacctctgatctggcctctacgagaggtcctcatctccatctggcccaacaattcccagattctgaagcttggaatgcaaacacaggcttcatgggctgtggcctctgcagcgacctgccatccccaggccttgcctgaggggtcaggctgcctctcccaacacacactcagatagcacaaattctaccatccccttccctggctgctggaaatggaccccgcaaccctgtcctctgctgggcccccagcaaactctagcaatagcagctgctgccgtgtcattatgcaaagcctctgaccagtttgctgcagcatttacatctgccctaatcagaggggccacctctaactcctcctcctcctctcttctcctctggtttgcgtccttcctgggttgggctggagtctggactggctgagataagagcctggcaaccagcaagagctgggctgtatttggagatcatgggctgattccatgttcttgggcaacagtccagaagcatcaggggctccggcctgggatgtttctgaactttgggagttataggagacaggaggaacttctcctcctcctcctcccctacaattccttttcacatattcctttcttctccctcttgggtgaccttccaaaactctgctctcaggctgaaatctggcatcatctcaggttccctgtccccagcactgtccccatggagctggtggctgacaaagatgtagtttccatcagtcaataaaacctgagaggagagatgagg

SEQ ID NO: 30944 - DNA, 1861 bp, Homo sapiens
gggtcggggcctggatagggttggggtgagccataacggggaggaaggtgctgcccttatcgctctgctccatctactccaggacagcggcagtggcgaggaacaggctctttgtgtcaggaaccgttctgcctttgaacagcaacatcaccacttgctgcactgtctagagaagacaacgtgccatgagttcacagatgagctcaccttcagtgaagccctgggagccgtctcgccgggtggccgcaccagccgtagcacctctgtgtcttcccagccagtgggacccggaagcctgctgtcttcttgctgccctcgcagggccaagcgccgcgccatccgccttgccaactccactgcctcagtcagccgtggcagcatgcaggagctggacatgctggcagggctgcgcaggagccatgcccctcagagccgctccagcctcaatgccaagccccatgacagccttgacctgaactgcgacagccgggacttcgtggctgccattatcagcatccctacccctcctgccaacaccccagatgagagccaaccttcctcccctggcggcggtggcagggccggcagcaccctcaggaactccagcctgggtaccccttgcctcttccccgagactgtcaagatctcatccctgtgaggggtaggcctgctgattcagagggtcctcttcatttttgggaactcctttccaaagccatatttttgggaggcagagaggggcaggcttgggcaccccttctgccccccccactgagaactatgcaatggagtttcatgaaatggtccacatagtggggaagtagccaggaaatgagaaacttcctcccaccccagacatttttcctggtgggagctgaagcactgggcttccacaggcccctggcctccttgccctagcacactgggactggccccactctcccagctggactcctgcatgctcctccccttgggctctcagatgaaggcaaagctttgatccgacatctgagctctagcctaagaaggagagttgagatttcctcctccctctggctgggatatggagctttggaggttcagagaagagaaccctcacctctgatctggcctctacgagaggtcctcatctccatctggcccaacaattcccagattctgaagcttggaatgcaaacacaggcttcatgggctgtggcctctgcagcgacctgccatccccaggccttgcctgaggggtcaggctgcctctcccaacacacactcagatagcacaaattctaccatccccttccctggctgctggaaatggaccccgcaaccctgtcctctgctgggcccccagcaaactctagcaatagcagctgctgccgtgtcattatgcaaagcctctgaccagtttgctgcagcatttacatctgccctaatcagaggggccacctctaactcctcctcctcctctcttctcctctggtttgcgtccttcctgggttgggctggagtctggactggctgagataagagcctggcaaccagcaagagctgggctgtatttggagatcatgggctgattccatgttcttgggcaacagtccagaagcatcaggggctccggcctgggatgtttctgaactttgggagttataggagacaggaggaacttctcctcctcctcctcccctacaattccttttcacatattcctttcttctccctcttgggtgaccttccaaaactctgctctcaggctgaaatctggcatcatctcaggttccctgtccccagcactgtccccatggagctggtggctgacaaagatgtagtttccatcagtcaataaaacctgagaggagagatgagg

SEQ ID NO: 30945 - DNA, 189 bp, Homo sapiens
cctcttggacacagcagaaagttcatggatattggacacctattggatccaaattttgaattttaattctgctatttgaaaaccctgtaacctagaacaaattatggaaagagaaggggattagcactatctctgtgttaccagctttactgatataaataaataatacattacttacctgcattgctt

SEQ ID NO: 30946 - DNA, 431 bp, Homo sapiens
gaataacagaaggtcacctaattcctgacataagaaaatgaccattcctggaaagtttatccataaagagacacgaaaaagtggaccagaagacaacctagaattgaaagatcagcgtagtcatcataaactagactagtggtcttcaaactggattgcatgatgaactcatttggaaggcttgttaaagcacagattgcttggcacaggcccgtaagtttccattcagaaggcctggggtcgggcaggagattccacagttctaacaaagtctcaggtaaccttgataatgatagttccaggaccacaccccgagaacccctggactactacacgataagcatttccttgagtaactgctggttaaagttctcacaaattcagtcttgatgttggattaaaagtcagttgaaaaagtacaggataagtaa

SEQ ID NO: 30947 - DNA, 390 bp, Homo sapiens
agcgtgaacagagcccagctttgcagccagaaagatctggcttttactcctggcaccccacttcaagctgtgtgacattggacaaatcacatatcctagctcaggcgcagtttctttacctgtgaaccgtctgtcccacctaccttaaagagttgccatgagggccagacaatgcaatgactaagagcgctttggaaaggagaatgctggatgcaggtgtcgtcgttattagtgtccagcccatcctttttatgtgcagctctgtgaagacatcttcccttgatgtcagaaccaaaaaacccaagcaaagcaaagacccagggctacatttctgctctggagtctcttgtatgacagtatctatgttgggcttttcagtgtgtaaaccga

SEQ ID NO: 30948 - DNA, 411 bp, Homo sapiens
taactacattcttttttacttgccataatggaaaaactttattaaacaaattatgcccactgttgctctgggatttggggactaggtaggcatgatttcaatggaaaataatttagtaatggtatgtctcaataatgtatcaacaacctggaaagtatatattctttgacttaggattttcatttctaagaatttgtcttatagaaataatagtaggtcaaaacaagaatgtagtcataagagtatttactgcaatgttgtttagaagagggagaaaacaaatgaaaatgggctgggtgcagtggctcacgcctgtaatcccagcactttggaaggctgaggtgggtagaccacttgaggccaggagtttgagaccagcctggtgaaaccccatctctactgaaaaaacaa

SEQ ID NO: 30949 - DNA, 378 bp, Homo sapiens
gcccagaaaagtctataatgggtagattcaattgacagtctggagacttgattttatgtcctggctccttccccagattgtacaccataatctctctctgtctcaaattccccatccttcaaacatgtccaacaacccgctatgtaaccccaactttaactgcattgcttatgagtttgaatgaaataacaatatgagtaaaggacacaggaaaaaaaatcaactgtctatgccaatatcaggcttgtaaagggtatgggtcactttctatcaagaaaccttgggtagttgagtgaaccacatttttctttagtgtgcctttagtgaaaaatgactaattgaataggattgctaggcaccagaacttcagctttcaaa

SEQ ID NO: 30950 - DNA, 1329 bp, Homo sapiens
tgccgtggttactacgggctcctctttcatccgggctctactggtgaaaataactgcagacggctggtaaaaagttggaatagctttcgttaagcgtcggatgtgtagagtgctgagttaggggctggactagagacgttgggacatctcccgggaacagcagcctggaggggaaaaatctcctgacctaagtggtcattcggccttggcgcttggacacgggagtgcggcgacagccatatgtccatccatcttggcacttttccgtcctctgcctttgaagatgggtgtgcccggcaggctgtgaaagataaacattagagggttgtttagaagacttttttgacctgagcccatgaggtgcataccctttgtttggcggagaaaccagtggcttctgaagatcagggacgggccacaagtgcgaggcattgcagacatttcgaacccagacttccagcctggagacatccacacgcttccagtttcttgcactggtacttcattctgtcattatgattgccaccactcgtaactgagagttgcgtgccctcaagttttgagtgtctgcagggtacctttgagctttcttagctgtgtagtgagtggggggaatggagaaaatgaaggacagatgactgatttgtagtttttcatttggacactgtccttgccgcacaagcacagcagcttgaacctctttgaacaagagtcgagagttcttttacagctaattacccactagttaaacttgatcatactgtgctgttttcttcctctccattgtcaatgtaatacggctcctgacaaaagttaaattcgctgggcgtggtggctcacccctgtactcccagcactttgggggctgaggcgggtggatcacctgaagtcaggaattcaagaccagcctggccaacatggtgaaaccccgtctctactaaaaatacaaaagttagctgcgtgtggtggcgggcgcctgtaatcccagctactcaggaggctgaggcaggagaatcgtttgaacccgggggggcggaggttgcagtgagctgagatcgcgccactgcacttcagcctgggtgacagagtgaaactccgtctcaaaaaaaaaaaaaaaagccgggcgctgtggctcacacctataatcccagcactttgggaagccgaggggggaggatctcgaggtcaggagttggagaccagcctgaccaacatggagaaacctcgtctctactaaaaatacaaaattagccaggcgtggtggtgggcacctgtaatcccagctactggggaggccgaggcaggagaatcctttgatcccgggaagca

SEQ ID NO: 30951 - DNA, 1046 bp, Homo sapiens
tgccgtggttactacgggctcctctttcatccgggctctactggtgaaaataactgcagacggctggtaaaaagttggaatagctttcgttaagcgtcggatgtgtagagtgctgagttaggggctggactagagacgttgggacatctcccgggaacagcagcctggaggggaaaaatctcctgacctaagtggtcattcggccttggcgcttggacacgggagtgcggcgacagccatatgtccatccatcttggcacttttccgtcctctgcctttgaagatgggtgtgcccggcaggctgtgaaagataaacattagagggttgtttagaagacttttttgacctgagcccatgaggtgcataccctttgtttggcggagaaaccagtggcttctgaagatcagggacgggccacaagtgcgaggcattgcagacatttcgaacccagacttccagcctggagacatccacacgcttccagtttcttgcactgtaaatcctgctgctgctcactctttgggtctgcactgcctttatgagctgtaacactcaccggaaggtctgcagcttcactcctgaagccagcgagaccatgaacccaccgggagaagagaacagtgctgtctttatgagctgtaacactgtaacactcactgcaaaggtcgaaggtctgcggcttcactcctgaagtcagcgagaacatgaacccaccagaaggaagaaactccggatacacctgaacatcagaaagaataaactccggacacaccatctttaaaaactgtaacactcaccgcgagggtccgtggcttcattcttgaagtcaacgagaccaagaacccaccggaaggaacaaatttcggacacaataggaaatctctaaggtggaatactatatcaaaagagagaagccaaaatgatatcatacgctgaaaatgttaatggaattccacaaccttgcctattaaaaactccacagtttgagcacagcatggaatcaaaatttaaaaaataaacatgacatagtatttttatcatttga

SEQ ID NO: 30952 - DNA, 475 bp, Homo sapiens
gccttgggttgcaggagctttgagaactatggggaaagaaacatgcgacgaagaggaagccgtggtcagagtgcagcacatactgagggtgttgttacatttacttgaactgcagtaaaaggccattgaaaggatttgggcaggactgttacattatccagctaaggtattaaatgatcttgtgagctgctatgtaggaataagattggaaaagatttctgtttttcccagtatggcggacaaggtcctctaaacaccccttttgctgtaaagcagctagaaatgctgcatttaaaaataaatgtcatttaaaatgaattgctgagttggtaagaaatccttagaggccaaaattgaagtgaaaacaggaatccagaaaagaaaggaagccagctctgcagctggcggctacccagggtaacatccagagtcagaggaaggagatatatttaaatgcgaggacatttggataatt

SEQ ID NO: 30953 - DNA, 1333 bp, Homo sapiens
ataagttattacttataatcagtttttttattgttactatggcaatattttatacacaagaatggctgaggttaggaatttgtgccctgaaaattgtatcaacatatcaaatatgaagtaaataacaatttcttgctttaaatataacaaagatgtgggaagaagtggtaggcaagagtctctgtgttaccatgggaacgattaagttttccaaggtgcaaaccagcctcattccagcttcagggtcaatgacttactagctcagagggaaatgtataaatatttaagtacatacctactatctgtacagagtgactctcattacccagagaactgctgtaaaatattatttattcacagattacacaaaaccaatctaaattagtacttttatacattctatttggggagtacttaaggtgtatgagcaaacaaattgttatccaggtcactccagaactgttgtatacagattaagaattgatgttggatactaattaaaatcattaaagcaaaatcaaaaaacactttggctagcatttcaattattttttaaacaggatttcttaaaacaatccccaaagtagtcttgtaatttgttcattttaaggatctatgttactctgaggccaatcaagggggctaacagtctagttggggagccaagatagccattcatcaattcattcattcattcagtaaaatgtattgagaacctactatgtaccaagcaatgtgctgggcactaagcattgaagaatacctgaaacatggcacctgacctcaaaaagcttaaaattaggagacatagacatgtaagtaaataactgctataggcaaatctcagcaactgccacacctgcttgctcctttagcagaacttctctgattggccatattctgcacatagtgaccaactcacctcttttccctatctgctttccttgctatagctgagaaaaaagctgtggcccaaaagtttctcccctgagagggacaggatcagattgtcttttcaagagttcccatgtgcaatacagagctgaagttgaagctgaaaggattcatagagaaaggccagtataaatcttcagcataccaaagttatgagaaaggagaaagcttgcaatgcatgtatagaggaggtgctgaggagttggtggtagcagcagacaagggaggagaaatggatagaatcatggttattgtcaaggtggaggatccgtgaactgcaactgaagagggctagtgacatgacccagttcttagggctgtctctattcctgaatatttacttaatataaggcaattcttatatagcattagggtaaaa

SEQ ID NO: 30954 - DNA, 522 bp, Homo sapiens
ataagttattacttataatcagtttttttattgttactatggcaatattttatacacaagaatggctgaggttaggaatttgtgccctgaaaattgtatcaacatatcaaatatgaagtaaataacaatttcttgctttaaatataacaaagatgtgggaagaagtggtaggcaagagtctctgtgttaccatgggaacgattaagttttccaaggtgcaaaccagcctcattccagcttcagggtcaatgacttactagctcagagggaaatgtataaatatttaagtacatacctactatctgtacagagtgactctcattacccagagaactgctgtaaaatattatttattcacagattacacaaaaccaatctaaattagtacttttatacattctatttggggagtacttaaggtgtatgagcaaacaaattgttatccaggtcactccagaactgttgtatacagattaagaattgatgttggatactaattaaaatcattaaagcaaaatcaaa

SEQ ID NO: 30955 - DNA, 909 bp, Homo sapiens
ataagttattacttataatcagtttttttattgttactatggcaatattttatacacaagaatggctgaggttaggaatttgtgccctgaaaattgtatcaacatatcaaatatgaagtaaataacaatttcttgctttaaatataacaaagatgtgggaagaagtggtaggcaagagtctctgtgttaccatgggaacgattaagttttccaaggtgcaaaccagcctcattccagcttcagggtcaatgacttactagctcagagggaaatgtataaatatttaagtacatacctactatctgtacagagtgactctcattacccagagaactgctgtaaaatattatttattcacagattacacaaaaccaatctaaattagtacttttatacattctatttggggagtacttaaggtgtatgagcaaacaaattgttatccaggtcactccagaactgttgtatacagattaagaattgatgttggatactaattaaaatcattaaagcaaaatcaaacggcacgagctcgtgccgcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccaccttcaaccttgggccaatgtcttcaagctttactggggacctgcgagctggcctaatggtgtggcctgcaagccaggccatccctgggcgccacagacgaacttccagccaggttagggtttggaaggcccaagcttaacctta

SEQ ID NO: 30956 - DNA, 2471 bp, Homo sapiens
  misc_feature (223)..(223): n is a, c, g, or t
  misc_feature (293)..(293): n is a, c, g, or t
  misc_feature (1790)..(1790): n is a, c, g, or t
  misc_feature (1853)..(1853): n is a, c, g, or t
  misc_feature (1922)..(1922): n is a, c, g, or t
  misc_feature (2323)..(2323): n is a, c, g, or t
  misc_feature (2470)..(2470): n is a, c, g, or t
tggcgcggcgttttcctctggctcctgcgagggcttggtttagggcttcagctctctgcgttctcggctccgggaggcctcggtgattcagccacagcctctgcctcccgttgctctgtgacctgagggtattggacaatttgtagctaagactcccggataccctgaagtcgggaaatggtgagtgtgcggggcagggcgtccggaggctggggaggcctcntcggaaccggcgggaaatggcggcggcgggaccgagtctgcgaacggagtccccgctgccgcctctcagncctcagtcccctccggtgacggaccgggctcctgtcggtccccgcacggcggctctggcccagcctgcggccctccttgtgcagttctgcgcccgcagccccgcaccttccctgggccgtggggtgaggaggagctcatctggaagacgccggcgcccgcgtgcgaggtgcccgcctgggaggagctgtggtccgggggtccggtccctactttaccctgttcggaatgagatcgaggccccatcgaaacaaagttcatgtgagcaaacggggtctcattaatgggacagcgtcggccgcggctcctggtttggggactgccagcgggtcttgaaggaaaggcttttgtgaggtgtgtgagcaagcgaagcaaatcacccgcccgctccaactattccaccagtccctttgccctgtgcacctcctccgcgtggctgttcctgagtaacatcttttagaatacgctggtgtcggtgcgcacggcgcttctcagttctgtgagtagttctgccacattgctgaacttgagggtgtgggcgcccctggtttgtagacaggcgttcagaaatgaagacgggtgtccagaggcagggactggcgtctgcagcgggagcagttgtgggaagagcgctgagcttgtggggtctgcgctgactctgggtggtgtcgttagtgagttgctggacaccgcgttggggttggagcattgactggtgttgaggaaactccgcacgttttctgtcagaagaaagacatggctgagcctgggctggagaaagatgcctggtgtctgcgggaggcgcggccgggttctgcatatgtgctgtcccgctgggcactgtccttttcctccaggtctccttccggggagagaggggacccagaacaaagaggaaaggagttctgagaaacatcccttccctgcaccctgctgccagcccccacccaatgctagtccactcctgagcacgcccaccgggcattcgcattgccccactcttcccagtacaggattccacctcaggaattgtgcccatggcagctttgcgcctagcgttttctgccaaaaacacacgcagtgcccagaagtctcctggctcatctcaaccgcagaccggatctacagcaggaacctgcttccttcacccacccaggcttccggaccacctgatcctaatcccttctgtctttgtagacatggaatcagagcgtagccctgcctcggcctgtacctgtggcacaaaccagtgctttagtcagtcctgccctgctcccactcatggctttttttttttgagatggcgtcttgctctgttgcccaggctggagtgcagtggcgtgatctcggcttactgcaagctccgcctcccaggttcacgccattctcctaactcagtctcccgagtagctgggattacaggcgcccgccaccatgcctggctaatttttttttttttgtatttttagtagagacggggtttcaccgtgttagccagnatggtctggatctcctgaccttgagccctcccgcctcggcctgccaaagtgctgggattacangcgtgagccaccgcgcccggcctcccacccatggctgttgatagctcctttctcttctgctttttcctnccccacaaattctcttttctgtgtacacggtgtgcccaagtccatccctcaggtgcctatgagaattcagacgttagtgagttcgaaaccaggccttttggcctggctgttgtaggagcaaacacaaattagaagaggcttaatgctttctctttagaacgagggaagaatttttgctcttctcctttttcttaaagcatttagtttgagaacttttatatttaaatattttctctgcttctttgaaatatatgtaaatcatttttatcagttaaataggtcatttgtcttttttggctcaaaattgtcttcatctgggacctgggaactattgctttgaaatgtaaatagcaagaatatacaccctatttcacagtttctgtaggggactaggaggctgncttcagcaggtacctagctccacattgcaaatctacatcctgtcacgaagatgtggatgtttattttttctttaatgattagaaaaaattagaaaacccagatgacctctcaaattacatgatgaaattataataaattgtgtatgnc

SEQ ID NO: 30957 - DNA, 1264 bp, Homo sapiens
tggcgcggcgttttcctctggctcctgcgagggcttggtttagggcttcagctctctgcgttctcggctccgggaggcctcggtgattcagccacagcctctgcctcccgttgctctgtgacctgagggtattggacaatttgtagctaagactcccggataccctgaagtcgggaaatggaactcgtaacattcagggatgtggccatagaattctcccctgaagagtggaaatgtctggaccctgcccagcagaatttgtatagagatgtgatgttggagaactacaggaacctggtctccctgggttttgtgatctctaacccagacctggtcacctgtctggagcaaataaaagagccctgcaatttgaagatacatgagacagcagccaaacccccagttgttcagcacttctggtctcttcagttctgatatgattttaggattgcttcttttttttttttgaggcggagtggagtgcagtggcgccatctcgtttcattgcaagttccgcctcccatgttcacaccattgtcctgcctcagcctccctagtagctgggactacaggtgcccgccaccacgcccggctaattttttgtattttagtagagacggggtttcactgagttagccaggatggtctcgatctcctgacctcgtgatccgcccatttcggcctcccgaagtgctgggattacaggtgtgagccactgcaccacgtcaggattgcgtcttatgttaatgcgaaatatgcatagctgtcatccgaagtataccaccattcccttcagcactctacgtcagaggaggcacgtcaggggagacaaaattcctcttcggacagtccctcaaaagacaggaatgtggacatatattccacatttctctttgtctcctgaggaagaagcatagagttgggagtttctcctggattgcaccatgctgtattgggaggaggtcaggctgcgctgggcatatctaataagctttttcttctcttctacatgtttttggcattgtgctcaactgaagtagtacaaattcttaactatgttcaggaattctcacaaaggcaatgtgatcagcgtggtgttaagttcatatatctatgaagaaacgaggaccagtggtgtttgtttttacgcttttcattttaaatttatattttatttattattttaatttttgtgaggacgtagtacctatatgtatctatggattatatcagtgattttgatgaaggcatgaaatgcacaaaa

SEQ ID NO: 30958 - DNA, 790 bp, Homo sapiens
tggcgcggcgttttcctctggctcctgcgagggcttggtttagggcttcagctctctgcgttctcggctccgggaggcctcggtgattcagccacagcctctgcctcccgttgctctgtgacctgagggtattggacaatttgtagctaagactcccggataccctgaagtcgggaaatggaactcgtaacattcagggatgtggccatagaattctcccctgaagagtggaaatgtctggaccctgcccagcagaatttgtatagagatgtgatgttggagaactacaggaacctggtctccctgggttttgtgatctctaacccagacctggtcacctgtctggagcaaataaaagagccctgcaatttgaagatacatgagacagcagccaaacccccagctatatgttctcctttcagccaagacctttcaccagtgcaggggatagaagattcattccacaaacttatactgaaaagatacgagaaatgtggacatgagaatttacaattaagaaaaggctgtaaacgtgtgaatgagtgtaaggtgcagaaaggagttaataatggagtttaccagtgcttgtcaactacccagagcaaaatatttcaatgtaatacatgtgttaaagtttttagtaaattttcaaattcaaacaaacataagataagacatactggagagaaaccctttaaatgtacagaatgtggcagatcgttttacatgtcacacctaactcaacatacaggaattcatgctggagagaaaccctacaatgtgaaaaatg

SEQ ID NO: 30959 - DNA, 293 bp, Homo sapiens
ctcactccctcgaacatgctctggatcacaggtagtgccggtgtagaggtgctgttgtggagggacaaggatggagaatgatcacaaacaatggtctttgtctaagagacgtttgcactttgggatggggcagtgactccctccagagggagccccgttcctcccggggcgttctaatccatgtcagccccattccagctgggtgaggacgctctatggggtgtactggcagaactccccgctggagctcactggggtccatggcagctgccccagggtagctctgcccatcg

SEQ ID NO: 30960 - DNA, 532 bp, Homo sapiens
gaccttgtttcaaaaaaaaaaaaaagagttaattgtaccaggaacatgtggtgtcaaaatttaaaatatgtgaactctttgacccagcaatgctattttcagggatatatcctaagatcatcaccagcaaagtatataaggatgtgcatgcaaaaatattcatcatggctttctttatacaatgaaaaattggaaataaacttctcattaatgggatgctggttaaagaaaatcattactgtaatatgcagccatctaaaagggtaatttatatgtatatatatttacataagaaaaccctcatgtcatattgctgagtaaaaagaaagatgtcaatgagtattcatgatgtgattctatttatccttgcaaatggtggaaattcaattatatggtattttctctcttttctgtttgtttttcatatatgtatatatttcctttgaaatcagaaaaaaatcaagctattttcatcagaggaaaaaaatcattactctgtatttcagtcacactaaaatagtcacccaagaag

SEQ ID NO: 30961 - DNA, 335 bp, Homo sapiens
agctgggaacatatgaggattattttagaaggatttgtgcctcagatttaggctcgcccactattatttttgatggtaagtctgagtctacaatcatgttgagatagccatgtgttctttccctgtaacttcttaatatatgatttaagctgtttctgaaagctgttggcattgaactccatgtttatcgagtcgacttcaaatatttgaaggtgttggtaatgtttgttatttgccccgagaagccctgaatccatactgctgggtacagtttggctttctttcataatttcaacatatataaaaataagataatacaataaagtgattgaaga

SEQ ID NO: 30962 - DNA, 147 bp, Homo sapiens
atgcttgaaacttggtaggtgttcagtaatgctgttattatgatgatgatgaaaatgcctgaggattaaataaattaaggaatcattaagaactttaacagcccagagactgagttagagccatacttttagaactctatgccctgg

SEQ ID NO: 30963 - DNA, 320 bp, Homo sapiens
ttcaggctggcctcgaactcctgggttcaagataccctctggcctcagcctcctgagtagctgggactataggcgagcaccgctgtacttggcttatgtacaagatgttgtgtgaccctgtctcaaagataccaaaaaaacaaagcaaaacttacatacaaatgtttattacagcattcttcataatagccaaaaagtgaaaacaacccaaatgcccatcaacaacagataaaatggggtctctccatacaatggaatattatttaaacataaaaaggaatgaaatggtgatatgtgctacaccgcatagatgaaccttg

SEQ ID NO: 30964 - DNA, 329 bp, Homo sapiens
tttttgagacggagtcttgcagtcttgctctaacaccaggctggagtgcagtggcacaatctcggctcactgcaacctccgcctcctgcgttcaagcaattcccctacctcagcctcccgagtagctaggactacagtcatgtgccaccacacccggctaattttttgtattttagtagagatggggtttcaccatgtcggccaggattgaccttgtgatcttcctgcctcggcctcccaaagtgctgggattacaggtgtgagccatggcactctgcctctagctttctaattatctatgagctgtgtccacctggctattcagttca

SEQ ID NO: 30965 - DNA, 483 bp, Homo sapiens
ggcacatacacacacacacgcacacacacgggcctcctgtggtctcacttggtcctctttgtgacagtgccattgttaccatttacagaggaggaactgaagctcatggttgagcctctcacttgcccactttgccaaaccctggtagggatgggattagaggctccttttctttcgtgaaatgagacaacgatctgggggatcgttggaaggattaaaatgagtattcagattacaatgctggattcttaatagtgtcctctgttaataataataataatgtagtagcaacagtcacgtagtctttacagtcacaggtgcatgtgtgtagatggggttctctctgtattagccaggctggtctccaactcctggcctcaggctatcttcgcacctctgcctcccttagtgctggtattacagatgtgagccactacaccagcctgcagtttttactacaactctgtgaggtgattagtacta

SEQ ID NO: 30966 - DNA, 460 bp, Homo sapiens
ttttctatacctgataggcgaacttcaattgtaagaccaggtaaaatgttaccagtaaatagctctcagctcctgagccagaattcattgcttctgtaggggctggtaacttggtccagttctgctcagctgctcctttgttgcagactgagcccatgaccagaagcctcagctgctccagcagatggtggctagaattttttgagttgtttttaacctggtgctctgagactggggtgaacctagggagctgaagcagcaatgccacacccccaacacatcatacacacacacacacacacacacacacacacaccaggcacacgcataacatggacttacaacatgccatcatgttggcatgatgggcacgttataaggatgggctggcagggcgcggtgactcacgcctataaccccagcactttggcaggccgaggcaggcagatcacttgaggtc

SEQ ID NO: 30967 - DNA, 533 bp, Homo sapiens
caggttgaaaccaagataagcctgtgcattgagtctgaagaattgtactttttccaaatattacagttttgaaaactaatttatgaattgaagtagctaagttccatccagtttccaactcccattttttgacacagatcagaatgaaaaacctagaagccaatatccaaactttactccagacctttccactgttcaggcagtagttgaggactgagacagacgttctgaatgacaactttacggtgacaactgactgttaatgtcatgtgataacatgtctgtagcttttttggaaataatctaggatgatagaatgggaggtatctcttcaaaaatatgtatttagcctaattgctgaaatactttatatttttaggactgatatgactgctttttttcatttatttagtttataacttcatgtagtatgaattcagcctgaaattgacatttaaattttgtacctaaattcgtaggtttagtttttttaagaaaacaatggctttccagtaaataaaataatattttta

SEQ ID NO: 30968 - DNA, 443 bp, Homo sapiens
attaacagatcttctccctcaaagaaggcatgtaaatgttttacattattgtcaaactgtaaacaataatgaaccagctctttaggtaaaagaagttaaacaatactactactaataataatttgcctctataaagggactttttccaaactctcgaggaaccagctgtagctgggtagcatccttccctcaggagtctgagaacacattctgaggggcccctgttctgtgcttctaggttctgataattcaaccactacttctttccccaatctagggaggtagatgcctcctacagttactattagtagtaacctcatcagggtttttttggtttattttttgtttgtttacaaatgctttttgctctttaagttttcaaatgtattttaaactaattttctaaattaacttctttctgttgaaataaaaattttccattc

SEQ ID NO: 30969 - DNA, 128 bp, Homo sapiens
catagtgaattatgatcccaaatttttattttcttttcacattgctataacaattacccaaagatgtgaaagtggctttagaactgggtaatgggcagagacttggaagaatttcaaggaacaggcta

SEQ ID NO: 30970 - DNA, 485 bp, Homo sapiens
gtcttctataaactaacttctactccacccatcttggtaataaccactgttctctgttggcttctgcctcctttctcaaaacatccattccctttgccctccccatgttcttagtggagaagtcctgtgcagtttctgtacttgataccgcatccactttgcagttgacttgaaataacaactaaacctttgtcattgacacctgtttcgtctccacactgcatccttcttcagattcttggtctgtcacaatccttgttgctgttcagtaggtgaaggcaaagtcaaagggttgagtctaaagctgatattgtatgtgggtgtaccacacatgcaacagtctagaaaaatctatcacaaggctgggcctggtggctcatgcctgtagtcccagctgctcgggaggctgaggcaggagaatcgcttgaacccaggagggggaggttgcggtgagctgaggtggcgccactgcactccagcctggg

SEQ ID NO: 30971 - DNA, 380 bp, Homo sapiens
atcttcattctattacctccatgtacagtaatataaagtaacatttcccaaaatatattctaaggaaaacttaggtcctcaggagacaaggatgaacaacgttaaataaatctcttctttagtgaaatatctctcacagatcttattttgcacactgtgaatctgagagggggaaataccatacattataagatcaaatcacctttatagtgaaggatctggcaagtccagaaattgctcgaaacactgatgtaaaccattactaaggcctctaagagcaaagaaaataccatggatgagtcagtactagtgcagaaagattctaaatactagaggagaactctagtatttagaattagtagtagttaaccaaatgttca

SEQ ID NO: 30972 - DNA, 683 bp, Homo sapiens
attaaacaccatgcagaagctgtatgattttggacccccttacatcaatctccttatctgtgaaatgggaataataaaatctacctcacagaattattaacagaattaaatgagataatccatggaaagctagtagcagcatgactaacacagaagtaagcactgaataatgtacacatgttgatgacagttgatttttatatgcgttcttatgtcatagacatttgttgttattaaaaatatcacaggggagcgtggccctgctgtaaaaaaaacattacaagatatcatggtggtggagaatgattccattgtggtgacttccatcacagctctcagctgtgaaacagccccagggccctggaaaagagcccccaaggacttagtttctaggaagaaggttcggcctttggaggggaacagtttgcccattgcctccacaagctctgctttctttccctagcctggagatttttgtgatattcatagtaaggaaaataaatttttgtcttgacttagtaatgatagttaatgggtactataataaacagtcctacaggccaggcgcggtgactcacgcctgtaatcccagcactttgggaggctgagacaggcggatcacctgaggtcaggagttcgagatcagcctgaccgacatgatgaaaccccgtctctactaaaaa

SEQ ID NO: 30973 - DNA, 438 bp, Homo sapiens
agttcttatatttaatctgaatatgaatactgatacagaataacaaagaattgaggaaagtgatttttatttctttatactaaaataaaatcctttttgctttcagtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtaaaagtaaattcttttctacaactagatggaaaatggcatactgaaatcatttttttgatgatttcttaataaatatttat

SEQ ID NO: 30974 - DNA, 458 bp, Homo sapiens
agttcttatatttaatctgaatatgaatactgatacagaataacaaagaattgaggaaagtgatttttatttctttatactaaaataaaatcctttttgctttcagtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatgtaagacttaacccttta

SEQ ID NO: 30975 - DNA, 415 bp, Homo sapiens
aaaccttttttaaacaaactatggctatttttaaatctacattacatcttccatatcttcctactgccttctagcatttcacttttgagaaaccctgattttgagggacatcttatgcattcatatttaatgaccagccaggcttacacatgtaattgcagtactttgagaggcagaggtgggaagatcacttgagcccagtagttagagaccagcatggacaatgaagtaagaccttgtctgtacaaaaaactttaaaaaaattagccaggcatggtggtgtgtgcccatagtcccagctctttgggaggctgagatgggaggataatttgagtccaggagatcgaagctacagttaactgtgatcatgccactgcactccaacctggatgacagagtaagaccttctttcaaa

SEQ ID NO: 30976 - DNA, 1187 bp, Homo sapiens
cattaacaaagatggtgcttatggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactataaaaaaaatgtgcctcactcatgaga

SEQ ID NO: 30977 - DNA, 632 bp, Homo sapiens
cattaacaaagatggtgcttatggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcagttgccatcatcaggcttcctagagaattgagcctgcccactctgttatgaagtctacccagaagagctggcagagtaggccccttcactgggactgcagcaacactgaccaaagcaaatccttctcttggaagaaacaaactcattcctcacacctgcctcaccccgctcccaccgccaccccctgcaccacacgccagcccttaataaaaactaaaactgatgtcattgta

SEQ ID NO: 30978 - DNA, 1469 bp, Homo sapiens
atgcgccacgccctgttcctccttcatcacccagctcctcctcctagtgttcagggcttagctttagcctccttcccctggaaggccttccctaatgaagttaggagctcctctgtataaccaaaggcactgctcactggttttgctgggcacatttataaccattcactcaatgtcatgcttcttagcagactggcctcaggcaaataagaatctagttcaggaagtgtaaggtcagatttcctcgttgccccgtctcatacttcctgttcctcttctgggctctgcagaacggtaactccactcttgtggcctctgctatgaacaaaccccgctctcttcccttcctgctaccctatggccccttaggtttattttgttctcagcagccctcttggctctggcttctgttagcagctacacgttttctcggtaatatttcaagttcaacctcatcggcgagggtagctgtttggtttagcctttgtcctctagcacgtgcctttcctgcagggaggggcattcccagccttggaacaggccccatcactaaggccacagacagtgccagagggagctggggtctgtgcagccattcttgaattcccccagaatgccttgcctggccttgagtaaaagggatagaagtgaaaaaagcctgttacaaagcagcatgtacgaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactataaaaaaaatgtgcctcactcatgaga

SEQ ID NO: 30979 - DNA, 1194 bp, Homo sapiens
ttaaaagaaaggattcaaacttagtactaatctgcatctggagaactaatctggtatgtgttattttcaagtcacccaactaaagcagtctgttgtatggaactctgctccctcttagtcaaacaaatgcaaccataaaaagcagtgcaaattcagtgtcaccttttctccatgggattgggtggtttcttttggagcagagagagtttccagagaatcaatatagtagccagaagaaaagtggagggtggccttaccttgtccactccgtgctgcctgagggtgaaatggaacctcggatgttgtacacctttaaattgtccatgttgcctgtttcatagccttcccgggccagggagctgtgtagtcagtttatagttctaagaaccagagcaggactgctgtgcttgtaattgcatgctttttatggaacaggcaatgttgtttagggaatttgggcagctggaacctgccacattagcaatttggactgaggaagaatttcagggtgataaaataaagctcattatataaattcacttgggtatttaggaggctgagaagggagaggatgagagtattccaaaggcaagcaggagagtttcataaacaggtccctttctattcgtttttactgtaagtgttgaattgagctaggaggatcacatggcccattttgcaaagggcagtcatgttctgctgtttcttagctgttttgtcagttggaacaaaacaacagcgctgctcattttttgcagggttagaggaaaaaggaaggactggccgaagaatggggtggggagctggagaagagaagggccaaaagtgtcagactgtggggatgaggacctgaaggaggcccatgagacctcaggcatgggccctggaactctgcctttttgaagcctgttgacaatctcaccctaatttaaccctttgtggaattcttccatgagatgcagttgccatcatcaggcttcctagagaattgagcctgcccactctgttatgaagtctacccagaagagctggcagagtaggccccttcactgggactgcagcaacactgaccaaagcaaatccttctcttggaagaaacaaactcattcctcacacctgcctcaccccgctcccaccgccaccccctgcaccacacgccagcccttaataaaaactaaaactgatgtcattgta

SEQ ID NO: 30980 - DNA, 435 bp, Homo sapiens
ttcatgtcccgccggacattcaaggaatccgactatgttttctatataaacatatagtatttttcacatctgaaaatatacactgaattttccaggactgtgtataaatagaggtacaagaatctgagcctcccttgtcctttagtgcaatcaagcagagtatccacatactgaaatacacaacattttctgattacaaaggcccaggaatagctagttagcttgccctggtgtcactgctcactcctgtgaagaataaggataaaccatgaggatagtagtggtaatggtgaaacagaaagaacacagaaagctgattctagagtagggctatctaatagaaatatcatgcaagccaccaattggagccacatatgtggtttacatttggaagtagctacattttaaaaagtaaaaagaatatgtaacattaat

SEQ ID NO: 30981 - DNA, 1133 bp, Homo sapiens
cattaacaaagatggtgcttatggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaattcctagattccctacaggagtttccctgggtcagggagaagctgaagaaggcaagggaagaggccatgaccgacctgcctgcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactataaaaaaaatgtgcctcactcatgaga

SEQ ID NO: 30982 - DNA, 978 bp, Homo sapiens
ttcatgtcccgccggacattcaaggaatccgactatgttttctatataaacatatagtatttttcacatctgaaaatatacactgaattttccaggactgtgtataaatagaggtacaagaatctgagcctcccttgtcctttagtgcaatcaagcagagtatccacatactgaaatacacaacattttctgtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactataaaaaaaatgtgcctcactcatgaga

SEQ ID NO: 30983 - DNA, 844 bp, Homo sapiens
tgaggtgtgcctttcaccttctgccatgattgtgaagcctccccaccacatggaacggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactataaaaaaaatgtgcctcactcatgaga

SEQ ID NO: 30984 - DNA, 508 bp, Homo sapiens
cattaacaaagatggtgcttatggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtaggcctcagaaagatcactttgaaccagctccaaaatgttgtaactatgctctttgcttttttgtttatttgtttgtttgtttttgagacagagtcttgctctgtt

SEQ ID NO: 30985 - DNA, 466 bp, Homo sapiens
taacagtcaggattccggttgcagtttttctcccccgccccaaagatacgtggttgcagacgtaagtaacaggaatccatctttctttgaaagtcctgcattgtagcgtctgcgacctgggccctgcgggggcttccccgccccgctaacttgctccgcatttccgatccgggccaaggctgggtggctgcggcagtgccggaggcccgctctccccttggtccgctctttagttcattcccagcactccctctttagcgggtcaagttgccgcagaaaccgcccgtagtcttcctgtttgatacaagggtttcagcggccgaagcagagcctttttaaatagttcccaatgggcgctcacggccaaacgtgaacacctcccctcctcacctgtcacctcctgaactttacagggttgcgagggggagtgtgggatcgggtgtcgcctagccgtggtcgtactgcc

SEQ ID NO: 30986 - DNA, 328 bp, Homo sapiens
atggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtaggcctcagaaagatcactttgaaccag

SEQ ID NO: 30987 - DNA, 461 bp, Homo sapiens
gacccgcagtgtgatccctggcacgcactgactttgatattccaggcacacggactggctatttatcaccacttctttttccccactaagattcctgtgccttttaaggcagagggagatccctatggcgttagtcttcccaggccttaaagggcccttgtcttcactcacaaacctcttatctcttcttctccttcctctacattttaaagggggagagggaaaagtaaccgggagacaaattgagccacatattttcagacacttgttaccatattttaaaatctggcttcacatacacagagtctttgctatgcaccatgtactgttctaagcttcttaaaaatagaatctcaattattattttgcaggcaatactctgtgcattcattagctaggacaacaatgcatttgcagtagtgagatttcgttaaaaaattaaagccatttactatgatctg

SEQ ID NO: 30988 - DNA, 470 bp, Homo sapiens
ggacgcgtgggtcgacccacgcgtccggacccacgcgtcgcccacgcgtcgcgcaaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaat

SEQ ID NO: 30989 - DNA, 356 bp, Homo sapiens
gagtctgagtctttctctgttgcccaggctggagtgcagtggcacaatcatggctcactgcagccttgaactcccaaatagctaggactacaggcacgtgccaccacacccagctaatttttttattttttggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaat

SEQ ID NO: 30990 - DNA, 1181 bp, Homo sapiens
atgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaat

SEQ ID NO: 30991 - DNA, 453 bp, Homo sapiens
ttaagtgtgttaagacaacgatcagctgccctcagcactgatgtcagcattggcatctcgggtagaaccagtcagacaggcagacacccggtgtgggagcttgggttctgcctggcactgagagttcctaaaggcttgtcttgggcacacagtgtgaggtgctgtcttctcgctggtgctgaaattcacgtttctgctgtgtctttcctgtgagggccagtcccagacatgcttctggacattaccatatcccttctaggaagatgctgaacatctccagggacaaattggagcctgaagcctcagagctactgatgatgaaggaaagaggcaaacattcaggagccacagtgcaagctgaggacaagagaaaggcaagtggggccaggccacacacaccttgttcccacctttgggctttttatcttcttcttcttccgtttgtgccgtctg

SEQ ID NO: 30992 - DNA, 487 bp, Homo sapiens
tttttagaagattcagtgagagccaagttttcttttctcactgtaatcatagggattggttcattaggtaaattaagaaaatgaaattaaaaattaaaacagaaaaggaactccaaaaacaaaaacaacaaaacaaaattcatttatcctcttcttagaatttcagccaaataaaggtatatccaagttgaacctcccaatctaaaaatctgaaatctgaaatgctccaaaatccaaaactttttgaggcaccaatataacaccataagtgaaaaattccacatctgactgcatgtggcagggtgcagtcaaatgcattcgaaactttgtttcatgctccaaattatttaaaatcatgtataaaattaccttcagggctacctgtataaagtgtatattaaaacgtaaatgaatttcgtgtttagacttgggtcctatcccctatcctgaagatacttcattgtgtttatgtaaatattccaaaata

SEQ ID NO: 30993 - DNA, 567 bp, Homo sapiens
ttttcgactgatttttgtattcaaaattttgtggatgatttttaaatttacggtgtgctaggcattgaaggtaaaaatggtgaacaagtccttgtagagatgaattatcttcccatctcattaccttcatctcttcaaacttgggtgctttagaaaacgtgtgagggtacttgcagcaatgggatttttgagatttgcattaggagggcattctgaggtggcctgtcctgggacttcctgatgccagttaaaaactagtgtttcttgcttttgtgtatccaagctttgtgatataccacctgtctgtctaatggagagtgcatctttagttgtgtatgatatgtgctctcaggagaaaatgctttcttgcatgttatgcaatagctatgatttcctcttatgagtttacatcaggaatatcatggtatttatattagaaatttatatgaggctgggtgaggtggctaacacctgtaatcctagcactttgggaggctgaggtgggaggattgcttgagcctaagtgtttgagaccagcctgggcaacatagcaacacctcatgtgta

SEQ ID NO: 30994 - DNA, 544 bp, Homo sapiens
ggttttctagatcttaccgctattggtttccaatttaattctgatgtggtcacagaacatactgggtttgattttaatgtttttaaatttactgagactttttgtataggccagcatactgtctatctttctttggaaagaagtacatcctgtagttggtaaatgctttgttccataaatattggttacgtccatctagaagttttgggcgtttcccccaacaactcctacttcctcactttgtttcatttactgagagataaatgttataatctattactgaaatgtagatttatctaattcttccttcagttctataaatttctgattcatgtactttgaagctattaaatacacacaaatttaggattgttatgacttattctgaattaatactttcatagtgatttaatgatcctctttatttcttatcaggtggtctataattcaactttgtgatacattaaaaaataggggtagcagcttttttctttcaagcacatctcttttaggcagcatatacttgggctttgctttttcctct

SEQ ID NO: 30995 - DNA, 456 bp, Homo sapiens
ttatgattgccaattagtgactatgtggccttgggcgagtcttactgagccatcgactctccttttcctcatgatctgggggatagtaatgcatacattatagattggcatgagaataaaggaaggtaccagtgaaaactgagacttggggctggccacatagcagatgattaaaaaaaaattggcatccttgccgggcacagttgctcatgcctgtaatcccagcactttgggaggctgaggctggtggatcacgaggtcaggagatcgagaccatcctgggtaacgcggtgaaaccccgtctctactaaaaataccaaaaaaaaattaacagggcgtggtgggtgcctatagtcccagctactcgggaggctgaggcaaggagaatggtgtgaacccaggaggcggagcttgcagcgagccgagattgcgccactgcactccagcctgggtgac

SEQ ID NO: 30996 - DNA, 866 bp, Homo sapiens
tgaaaagaaagaaaacccacaaagtacctttatgcaagagatgtcttaagtataggaatacaaaggtttgaagtaaacaagaatggaaaaattataatatgaaatacaaaaaacaaaaacgatagggcaggggactatggtggctattgcaacattattcaatgtagaccttaaggtgaaaagtattacaaagagagacaatttgtaatgataaaagatttgattcaccagaaagtttcaacaggtctaatattttaatgatttaacaatatagcctcaaatatataagcagaaatgaacagaactaaaatgagaaaagacaagtctgcattcccagattttaatatactcagtaacagaacagcagccatgcaaaaatacgtaaatatgtaaagattggaataatactttaaaacttaacctaattggcatatatgaaacagaatacccaacaactgcaaaatacacattattttcaaatgcagatagaatatttatcaaaactgaccatattccaagtcataggaatggaatatattctttggccatgtatcattcacttagaaatcaataataatttcaaaaatagaaaaattctattaagttcataaattaagaaatacacttttaaataactcatggatcagacaataaattacaatgaaaattagaatatatttgaactgagtagtgaaagtgctacatgtcaaaacttatggtagacgcctaaagccatgcttagaaggaaatttatagtcttaaacgcacattaaaaaaaaaagattgaaaatgaacctagtagttaaaatattctaagaatagcaaattaaacctgaagaaaataaaggaaataataaagaacaaga

SEQ ID NO: 30997 - DNA, 1206 bp, Homo sapiens
ccgcccctccccgtctctccccgcccctccccgtccctcccgccgaagctccgtcccgcccgcgggccggctccgccctcacctcccggccgcggctgccctctgcccgggttgtccaagatggagggcgctccaccggggtcgctcgccctccggctcctgctgttcgtggcgctacccgcctccggctggctgacgacgggcgcccccgagccgccgccgctgtccggagccccacaggacggcatcagaattaatgtaactacactgaaagatgatggggacatatctaaacagcaggttgttcttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaagaaagtgttagttcactgcaaaccactagccagtatcttatcaggaatgtggaaaccactgtagatgaagatgttttacctggcaagttacctgaaactcctctcagagcagagccgccatcttcatataaggtaatgtgtcagtggatggaaaagtttagaaaagatctgtgtaggttctggagcaacgttttcccagtattctttcagtttttgaacatcatggtggttggaattacaggagcagctgtggtaataaccatcttaaaggtgtttttcccagtttctgaatacaaaggaattcttcagttggataaagtggacgtcatacctgtgacagctatcaacttatatccagatggtccagagaaaagagctgaaaaccttgaagataaaacatgtatttaaaacgccatctcatatcatggactccgaagtagcctgttgcctccaaatttgccacttgaatataattttctttaaatcgttaagaatcagttt

SEQ ID NO: 30998 - DNA, 1057 bp, Homo sapiens
ctgtgttgggcaggctggtctcaaactcctgacctcaggtaatccacccacctagacctcccaaaatgctggaattacaggcgtgagccaccatgcccggccatggttggtttttttgagaccactttatatttaggccaaataggtatgtgtgtgatgggggtggagaggatgacaagtagaatgaaggagtgatgtttcactttgccagactttaaattaattacattgcatggagctctattatgcaatactctctccatactgctgaaaaaaataatctgcaacttacaatttgatccttgagttaccaaccagtaacacttgttctttacaccctttctcattccctaagtcattagaaagcaccagttctaactccaaatgatgacatggtcttattttatctattaaccataagcttacagattctagtgaagaaaaaactttaggaggctacatggtctattggagagtgtaggctctgcagtcagaagatccctacccaggcttctgtctttctcagtaagacttgggaccacagcaaggtccgcaatctcctgaggctctgttttctatggttgggataacatggtaagttattttcttctaagtagtcacacatggaaatcttatctaaaattttataccattaacttttatttcacttattaactcataccattaatactttactttagctatgtttggtatgcatgagttaatgagtgattagagtactatgagcagcacaggtttagaaatgcctatttgcctatagtgcagcctcttacataggcaaaataaaagtcaagtaagaattttattttatttttttaaaatgcaaagtaaaatgtgtctttaaaactctcccaggaggtgaagggaagctaccataacaccaggtgggaaggaagacatactgggcttggctcatgctttaattagctactgtgtaaaaatgttcagggattttcagttatccgctggcacccagaggcaatgggtaaggttaactggagctagagccaatatttttttcttcctagaaggagta

SEQ ID NO: 30999 - DNA, 2830 bp, Homo sapiens
ccgcccctccccgtctctccccgcccctccccgtccctcccgccgaagctccgtcccgcccgcgggccggctccgccctcacctcccggccgcggctgccctctgcccgggttgtccaagatggagggcgctccaccggggtcgctcgccctccggctcctgctgttcgtggcgctacccgcctccggctggctgacgacgggcgcccccgagccgccgccgctgtccggagccccacaggacggcatcagaattaatgtaactacactgaaagatgatggggacatatctaaacagcaggttgttcttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaagaaagtgttagttcactgcaaaccactagccagtatcttatcaggaatgtggaaaccactgtagatgaagatgttttacctggcaagttacctgaaactcctctcagagcagagccgccatcttcatataaggtaatgtgtcagtggatggaaaagtttagaaaagatctgtgtaggttctggagcaacgttttcccagtattctttcagtttttgaacatcatggtggttggaattacaggagcagctgtggtaataaccatcttaaaggtgtttttcccagtttctgaatacaaaggaattcttcagttggataaagtggacgtcatacctgtgacagctatcaacttatatccagatggtccagagaaaagagctgaaaaccttgaagataaaacatgtatttaaaacgccatctcatatcatggactccgaagtagcctgttgcctccaaatttgccacttgaatataattttctttaaatcgttaagaatcagtttatacactagagaaattgctaaactctaagactgcctgaaaattgacctttacagtgccaagttaaagtttaccttattctcggccgggtgcagtggctcatgcctgtaatcccaggactttgggaggccaatgcgggcggatcacgaggtcagatcaagaccatcctgccaacatggtgaaaccctgtctctactaaaaaaaataaaaaaattagctgggtgtggcggtgcacgcctgtagtcccagctacttgggaggctgaggcaggagaattgcttgaacccgggaggcggaggctgcagtgagccaagatcacgccactgcactccagcctgggtgacagagcgagactctgtttcaaaaaaaaaaaagttgaccttattctctaaaagggctggctattcatatgatgaattgttaaggaaaacttaaagtggaagagaacacatgtgaagagactttgaaattatcaaaagaaaaaaaaaagaccagacaaaatctcatgtgccaataacttttcaaggtgcctttgttaaggaaattatatccacttaattactataatatataagactttatgaaaagcactttataaaattctaatttaaaaggtcaagaacttaacacttatttttttattcagtacagtgtgcctttatattaagtatgtgactcagtataaaatcactgaagtgtatcatgatttgattgtatcctgtaccaagactacttaccttgaatgctccaagatttaaaagtagtatgacatgttctcactctaaaataaactttttttttttttttttggaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagagggggggcggggccccataaccccccgggggggccccaccaccccccccttttttaggagccgcccccccccatatggaggcgaggtttattataataaaagggagaacgagacgcggcccggctatataaaaaaacaccagcggttcgaggggagaacaaaccgacacgcaggagcgaatgtgatgcttcaatggggagaaacaaccccaccaccattgtgggggggggggaaaaacaaatgtagggaacacccacacacacaagcagaatagtataacggcgcccacggggggaaaaaaaaaacaacggagcggtagatggatggtgggtgaacacaccacggtagtctagctctggggcgacagaaaattgcttcaccacagaaggattgataccccacctccactcccgcgccggggccagtacttaaaaaaaatggaggataaacacagtataagcatgcacgacggaaccaataaaacatagacaaataataagatggtcatatagaagaaatggaaataaagtgcaaggagtgacggagataaaaaaaaaaaccagacaaaatacaaaatgaatacatagtaagcagctacatagaagatatgtagaaggagaggaaaaataagtaaagataataggagagaatagtatgatactatagaaagagagaaatacaaaataaaaaaagagaatagaagaataaaaa

SEQ ID NO: 31000 - DNA, 2265 bp, Homo sapiens
ccgcccctccccgtctctccccgcccctccccgtccctcccgccgaagctccgtcccgcccgcgggccggctccgccctcacctcccggccgcggctgccctctgcccgggttgtccaagatggagggcgctccaccggggtcgctcgccctccggctcctgctgttcgtggcgctacccgcctccggctggctgacgacgggcgcccccgagccgccgccgctgtccggagccccacaggacggcatcagaattaatgtaactacactgaaagatgatggggacatatctaaacagcaggttgttcttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaagaaagtgttagttcactgcaaaccactagccagtatcttatcaggaatgtggaaaccactgtagatgaagatgttttacctggcaagttacctgaaactcctctcagagcagagccgccatcttcatataaggtaatgtgtcagtggatggaaaagtttagaaaagatctgtgtaggttctggagcaacgttttcccagtattctttcagtttttgaacatcatggtggttggaattacaggagcagctgtggtaataaccatcttaaaggtgtttttcccagtttctgaatacaaaggaattcttcagttggataaagtggacgtcatacctgtgacagctatcaacttatatccagatggtccagagaaaagagctgaaaaccttgaagataaaacatgtatttaaaacgccatctcatatcatggactccgaagtagcctgttgcctccaaatttgccacttgaatataattttctttaaatcgttaagaatcagtttatacactagagaaattgctaaactctaagactgcctgaaaattgacctttacagtgccaagttaaagtttaccttattctcggcgtgagccaccatgcccggccatggttggtttttttgagaccactttatatttaggccaaataggtatgtgtgtgatgggggtggagaggatgacaagtagaatgaaggagtgatgtttcactttgccagactttaaattaattacattgcatggagctctattatgcaatactctctccatactgctgaaaaaaataatctgcaacttacaatttgatccttgagttaccaaccagtaacacttgttctttacaccctttctcattccctaagtcattagaaagcaccagttctaactccaaatgatgacatggtcttattttatctattaaccataagcttacagattctagtgaagaaaaaactttaggaggctacatggtctattggagagtgtaggctctgcagtcagaagatccctacccaggcttctgtctttctcagtaagacttgggaccacagcaaggtccgcaatctcctgaggctctgttttctatggttgggataacatggtaagttattttcttctaagtagtcacacatggaaatcttatctaaaattttataccattaacttttatttcacttattaactcataccattaatactttactttagctatgtttggtatgcatgagttaatgagtgattagagtactatgagcagcacaggtttagaaatgcctatttgcctatagtgcagcctcttacataggcaaaataaaagtcaagtaagaattttattttatttttttaaaatgcaaagtaaaatgtgtctttaaaactctcccaggaggtgaagggaagctaccataacaccaggtgggaaggaagacatactgggcttggctcatgctttaattagctactgtgtaaaaatgttcagggattttcagttatccgctggcacccagaggcaatgggtaaggttaactggagctagagccaatatttttttcttcctagaaggagta

SEQ ID NO: 31001 - DNA, 456 bp, Homo sapiens
gacagctgtagttcgtattccctacctatcctcatgtaatataacttccatttaacttaaattacatgaaaatattattgacattgttaatatgaaatattactaaacttgattgtgtttattaaaaacattgctaatacctgctttgtaacacttagaacgagggcaggaccttgtctgttttattcattgtacttagtggatattacttagaaaaatatttttgagacccccccatccctcaaaaaaatttccattttttttttcactgctcaaatcacatagactttaaaaggctatgttcttatgtgtattaagagagggatgttgaaaaatagccttcccttcaaattctgtgtgtaaatccttccatttgttgagtatctgtgaagcactagcctcctgtatgttacctcaggaaatacccagagatatagggagatatttctgtcatca

SEQ ID NO: 31002 - DNA, 453 bp, Homo sapiens
tgcacatatgttcacagaagacttattcacaatagcccaaaggtgggaacaacccaagcgttcgcagaggaatgaatggatacgcaatgtggtctatccatacgatgggatattatccaggcttaaaagggaatgacattctgacacaccctgctacatgaatgaaccttgaggacatcatgcaaagtgaaataagccagacacaaaaggcaacatattgcatgattccacttctaagaattacctagagtcatccatttcgtagggacagagaatggagaaatgtttgccagggctggaggagaagggaatggagagtttgtgtttaatgggtacagaatttcaggttgggaagatgacaatgttctgtggatggatggtggtgacagttgcccgacaatgtgactgtgcccagtgccaccagactgtatgctgaaaatgactaagatggta

SEQ ID NO: 31003 - DNA, 389 bp, Homo sapiens
ggttaggtgtggatttctctgaaataggccagggaaaaggctgtgacctctccttgggtctgctgcagcgttctagccttggctaggtgaggggaactgttgggccgatgctgtgtggctggagcagaacccacagtgctgtccatagaggagaacaagcaacgaagatcatggctaaagatcttagagatccttaaaatgccgattcctaatctcttgctgaaaactactgacttttagatattttcccgcttgccactctgtaatccagaatattaggaacaagttcttaaactcgagtttacttttcactggtgtttgcatgtgtgggggacaaaagtttatgttcttgtggcaggaaactgtgggatctgcagcatggaggagtt

SEQ ID NO: 31004 - DNA, 1839 bp, Homo sapiens
gggagcgggggcggtacttcagcggaggccggagcgaggcgtcgggatgcagcgccccgggcccttcagcaccctctacgggcgggtcttggccccgctgcccgggagggccgggggcgcggcctccggcggaggagggaacagctgggacctcccgggttcccacgtgcggctgccggggcgtgcacagtctgggacccgtggcggtgctggcaacacaagcaccagctgcggggactccaacagcatctgcccggccccctccacgatgtccaaggccgaggaggccaagaagctggcgggccgcgcggctgtggagaaccacgtgaggaataaccaagtgctgggaattggaagtggttctacaattgtccatgctgtgcagcgaatagctgaaagggtgaagcaagagaatctgaacctcgtctgtattcccacttccttccaggcccgccagctcatcctgcagtatggcttgaccctcagtgatctggatcgacacccagagatcgaccttgccatcgatggtgctgatgaagtagatgctgatctcaatctcatcaagggtggcggaggctgcctgacccaggagaagattgtggctggctatgctagtcgcttcatcgtgatcgctgatttcaggaaagattcgaagaatctcggggatcagtggcacaagggaatccccatcgaggtcatcccaatggcctatgtcccagtgagccgagctgtgagccagaagtttgggggcgtggttgaacttcgaatggctgtcaacaaggctggtcctgtggtgacagataatgggaattttatcttggactggaagtttgaccgggtacacaaatggagtgaagtgaatacagctatcaaaatgatcccaggtgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaaatgaggtaaactgtatttaaaacctttgacttgagtctgctggtaaagcttctgaatattgagtttgctgagaaataaaaatcaaaacttctttaagctggtaaagtgaggggcccaccagcagtgatctcctgatgccttactggaaactttgtttacttgtctgctaccctctgatttgtttttagttagtttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgtttttttatttttaatgattttctttttgttattaatatttttctctgttcctttgttattacttgcatggtttggcgtcagaagtccttacctctttatattgtttgcaggtttaaataaaacagtgtggtgccattttga

SEQ ID NO: 31005 - DNA, 1848 bp, Homo sapiens
  misc_feature (337)..(337): n is a, c, g, or t
  misc_feature (341)..(341): n is a, c, g, or t
  misc_feature (343)..(344): n is a, c, g, or t
  misc_feature (360)..(360): n is a, c, g, or t
  misc_feature (364)..(364): n is a, c, g, or t
  misc_feature (374)..(374): n is a, c, g, or t
  misc_feature (378)..(378): n is a, c, g, or t
  misc_feature (403)..(403): n is a, c, g, or t
  misc_feature (409)..(410): n is a, c, g, or t
  misc_feature (415)..(415): n is a, c, g, or t
  misc_feature (439)..(439): n is a, c, g, or t
  misc_feature (454)..(454): n is a, c, g, or t
  misc_feature (463)..(463): n is a, c, g, or t
  misc_feature (471)..(471): n is a, c, g, or t
  misc_feature (488)..(488): n is a, c, g, or t
  misc_feature (505)..(505): n is a, c, g, or t
  misc_feature (509)..(509): n is a, c, g, or t
  misc_feature (511)..(511): n is a, c, g, or t
  misc_feature (533)..(533): n is a, c, g, or t
  misc_feature (539)..(539): n is a, c, g, or t
  misc_feature (543)..(543): n is a, c, g, or t
  misc_feature (548)..(548): n is a, c, g, or t
  misc_feature (556)..(556): n is a, c, g, or t
  misc_feature (565)..(565): n is a, c, g, or t
  misc_feature (578)..(578): n is a, c, g, or t
gggagcgggggcggtacttcagcggaggccggagcgaggcgtcgggatgcagcgccccgggcccttcagcaccctctacgggcgggtcttggccccgctgcccgggagggccgggggcgcggcctccggcggaggagggaacagctgggacctcccgggttcccacgtgcggctgccggggcgtgcacagtctgggacccgtggcggtgctggcaacacaagcaccagctgcggggactccaacagcatctgcccggccccctccacgatgtccaaggccgaggaggccaagaagctggcgggccgcgcggctgtggagaaccacgtgaggtataancaantnntgggaattgtgaattngttntacaattttncatnttttttatctaatatttttttaggnttaatnnatatntttttttttttttttttttttttnatttttttttagttnttttatttntttttttnttttttttttatttttnttttttttttatttacntttntnttttttttttttttatttattntttttntttnttttntttttatntcatatctnattaatggttttngtataggctgcctgacccaggagaagattgtggctggctatgctagtcgcttcatcgtgatcgctgatttcaggaaagattcgaagaatctcggggatcagtggcacaagggaatccccatcgaggtcatcccaatggcctatgtcccagtgagccgagctgtgagccagaagtttgggggcgtggttgaacttcgaatggctgtcaacaaggctggtcctgtggtgacagataatgggaattttatcttggactggaagtttgaccgggtacacaaatggagtgaagtgaatacagctatcaaaatgatcccaggtgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaaatgaggtaaactgtatttaaaacctttgacttgagtctgctggtaaagcttctgaatattgagtttgctgagaaataaaaatcaaaacttctttaagctggtaaagtgaggggcccaccagcagtgatctcctgatgccttactggaaactttgtttacttgtctgctaccctctgatttgtttttagttagtttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgtttttttatttttaatgattttctttttgttattaatatttttctctgttcctttgttattacttgcatggtttggcgtcagaagtccttacctctttatattgtttgcaggtttaaataaaacagtgtggtgccattttga

SEQ ID NO: 31006 - DNA, 1240 bp, Homo sapiens
gactacaatctaagtctttctgatttcaaagctcctgcttattaccacttcacagcacacctagaaagcataaggtgggagcaggttaaaatgcatacttgtctttggttatcccctctactttcctgtccttctctgcctacctgtatctgcatccttggtcactgtggaaaattatcttctagggtcctgtggtgacagataatgggaattttatcttggactggaagtttgaccgggtacacaaatggagtgaagtgaatacagctatcaaaatgatcccaggtgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaaatgaggtaaactgtatttaaaacctttgacttgagtctgctggtaaagcttctgaatattgagtttgctgagaaataaaaatcaaaacttctttaagctggtaaagtgaggggcccaccagcagtgatctcctgatgccttactggaaactttgtttacttgtctgctaccctctgatttgtttttagttagtttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgtttttttatttttaatgattttctttttgttattaatatttttctctgttcctttgttattacttgcatggtttggcgtcagaagtccttacctctttatattgtttgcaggtttaaataaaacagtgtggtgccattttga

SEQ ID NO: 31007 - DNA, 1751 bp, Homo sapiens
gggagcgggggcggtacttcagcggaggccggagcgaggcgtcgggatgcagcgccccgggcccttcagcaccctctacgggcgggtcttggccccgctgcccgggagggccgggggcgcggcctccggcggaggagggaacagctgggacctcccgggttcccacgtgcggctgccggggcgtgcacagtctgggacccgtggcggtgctggcaacacaagcaccagctgcggggactccaacagcatctgcccggccccctccacgatgtccaaggccgaggaggccaagaagctggcgggccgcgcggctgtggagaaccacgtgaggaataaccaagtgctgggaattggaagtggttctacaattgtccatgctgtgcagcgaatagctgaaagggtgaagcaagagaatctgaacctcgtctgtattcccacttccttccaggcccgccagctcatcctgcagtatggcttgaccctcagtgatctggatcgacacccagagatcgaccttgccatcgatggtgctgatgaagtagatgctgatctcaatctcatcaagggtggcggaggctgcctgacccaggagaagattgtggctggctatgctagtcgcttcatcgtgatcgctgatttcaggaaagattcgaagaatctcggggatcagtggcacaagggaatccccatcgaggtcatcccaatggcctatgtcccagtgagccgagctgtgagccagaatttgaccgggtacacaaatggagtgaagtgaatacagctatcaaaatgatcccaggtgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaaatgaggtaaactgtatttaaaacctttgacttgagtctgctggtaaagcttctgaatattgagtttgctgagaaataaaaatcaaaacttctttaagctggtaaagtgaggggcccaccagcagtgatctcctgatgccttactggaaactttgtttacttgtctgctaccctctgatttgtttttagttagtttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgtttttttatttttaatgattttctttttgttattaatatttttctctgttcctttgttattacttgcatggtttggcgtcagaagtccttacctctttatattgtttgcaggtttaaataaaacagtgtggtgccattttga

SEQ ID NO: 31008 - DNA, 1924 bp, Homo sapiens
  misc_feature (1240)..(1240): n is a, c, g, or t
  misc_feature (1251)..(1251): n is a, c, g, or t
  misc_feature (1415)..(1415): n is a, c, g, or t
  misc_feature (1435)..(1435): n is a, c, g, or t
gggagcgggggcggtacttcagcggaggccggagcgaggcgtcgggatgcagcgccccgggcccttcagcaccctctacgggcgggtcttggccccgctgcccgggagggccgggggcgcggcctccggcggaggagggaacagctgggacctcccgggttcccacgtgcggctgccggggcgtgcacagtctgggacccgtggcggtgctggcaacacaagcaccagctgcggggactccaacagcatctgcccggccccctccacgatgtccaaggccgaggaggccaagaagctggcgggccgcgcggctgtggagaaccacgtgaggaataaccaagtgctgggaattggaagtggttctacaattgtccatgctgtgcagcgaatagctgaaagggtgaagcaagagaatctgaacctcgtctgtattcccacttccttccaggcccgccagctcatcctgcagtatggcttgaccctcagtgatctggatcgacacccagagatcgaccttgccatcgatggtgctgatgaagtagatgctgatctcaatctcatcaagggtggcggaggctgcctgacccaggagaagattgtggctggctatgctagtcgcttcatcgtgatcgctgatttcaggaaagattcgaagaatctcggggatcagtggcacaagggaatccccatcgaggtcatcccaatggcctatgtcccagtgagccgagctgtgagccagaagtttgggggcgtggttgaacttcgaatggctgtcaacaaggctggtcctgtggtgacagataatgggaattttatcttggactggaagtttgaccgggtacacaaatggagtgaagtgaatacagctatcaaaatgatcccaggtgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagagtgggagggggagttaaatccagtcttatgaagtattgttattaaatgtctttttaaaaagagaaatataaacatatatttttactattaaaatattcagttttttaaatgaagtagaacttgagaacangtaaaaataanaaaaaaaaaacacaaaaaaaaaaaaaaaagagaaaaaaaagaaaaaaaaaaacaaaaaaaaaaaaaaaaaagacaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaanaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgtttttttatttttaatgattttctttttgttattaatatttttctctgttcctttgttattacttgcatggtttggcgtcagaagtccttacctctttatattgtttgcaggtttaaataaaacagtgtggtgccattttga

SEQ ID NO: 31009 - DNA, 1276 bp, Homo sapiens
  misc_feature (1177)..(1177): n is a, c, g, or t
gggagcgggggcggtacttcagcggaggccggagcgaggcgtcgggatgcagcgccccgggcccttcagcaccctctacgggcgggtcttggccccgctgcccgggagggccgggggcgcggcctccggcggaggagggaacagctgggacctcccgggttcccacgtgcggctgccggggcgtgcacagtctgggacccgtggcggtgctggcaacacaagcaccagctgcggggactccaacagcatctgcccggccccctccacgatgtccaaggccgaggaggccaagaagctggcgggccgcgcggctgtggagaaccacgtgaggaataaccaagtgctgggaattggaagtggttctacaattgtccatgctgtgcagcgaatagctgaaagggtgaagcaagagaatctgaacctcgtctgtattcccacttccttccaggcccgccagctcatcctgcagtatggcttgaccctcagtgatctggatcgacacccagagatcgaccttgccatcgatggtgctgatgaagtagatgctgatctcaatctcatcaagggtggcggaggctgcctgacccaggagaagattgtggctggctatgctagtcgcttcatcgtgatcgctgatttcaggaaagattcgaagaatctcggggatcagtggcacaagggaatccccatcgaggtcatcccaatggcctatgtcccagtgagccgagctgtgagccagaagtttgggggcgtggttgaacttcgaatggctgtcaacaaggctggtcctgtggtgacagataatgggaattttatcttggactggaagtttgaccgggtacacaaatggagtgaagtgaatacagctatcaaaatgatcccaggtgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagactttttacctcctcttttttcccctcatatctaaccatctataacctatgttatcttttcttcactnccaccgcccagtggtatttcacaaacccttcctaaaaatccggatatagcatttttaaatgtacaatctctcgatgtcccctatatgtttctcttatta

SEQ ID NO: 31010 - DNA, 2914 bp, Homo sapiens
gacgggagctgcggcgctggctacgagagtgacccagtcagcgttggttcccgtcttggccatggcctcgttcgtgacagaagttttggcacactccgggaggctggaaaaggaggatctggggacccggatcagccgcctgacccggcgggtggaggagatcaagggtgaggtgtgcaatatgattagcaagaagtacagtgaattcctgcctagcatgcagagcgcgcagggcctgattacccaggtggataagctatctgaagacattgacctgctgaaatccaggatagagagtgaggtccgccgggatcttcacgtatcaaccggtgaatttacagacttaaagcagcagttggaaagagactcagttgtcctaagtttgcttaaacagttgcaggagttttccactgctattgaagaatataattgtgcattaacagagaagaagtatgtcactggtgctcagcgtctggaagaggcacagaaatgcttgaagttattaaaatccagaaaatgctttgatttaaaaatattgaaatctctcagcatggagctcacaatacagaaacagaacatactttatcaccttggagaagagtggcagaagctgattgtatggaagttcccaccatcaaaagataccagcagtttggaatcttacctacaaactgaacttcatttatacactgaacaatcgcacaaagaggagaagacccctatgccacccatcagttctgtcctcttggcattttctgttcttggagaactacacagcaagcttaaatcatttggtcagatgctgctgaagtatatccttaggccgctggcatcttgcccatcccttcatgctgtgatagaaagccagcctaacatagttattattcgttttgaatctataatgactaacttggaatatccatcaccatctgaagtttttacaaagatcagactggtactagaagtgctccagaaacagcttctagatttgccacttgacactgacctggaaaatgaaaaaacatctactgtcccattggctgagatgcttggagacatgatctgggaggacttgtctgagtgcctcatcaaaaactgtttggtttattcgattccaacaaatagcagcaaattacagcaatatgaagagatcatacagtccactgaagaatttgaaaatgccctaaaggaaatgagatttttaaaaggagatactacagatttgctgaaatacgctcgtaacatcaattctcattttgcaaacaaaaagtgccaggatgtgattgtggcagccagaaatctaatgacctcagaaattcataacactgtgaagattattcctgattctaagataaatgtgccagagttacccactcctgatgaggataacaaactggaagtacagaaagtatccaatactcagtaccacgaagtgatgaatttagagcctgaaaatacattggaccaacattccttttccttgcccacatgccgtatcagtgagtctgtgaagaaattaatggaactcgcctatcagactttactagaggcaacaaccagtagtgatcaatgtgctgttcaacttttctactcagtgaggaatatcttccatttgttccatgatgttgtaccaacatatcacaaggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacctggcttcaggagacttgggacagaatgctttttggcccaaatgcgggcacagaaaggtgaacttctggaaagattatcaagtgctaggaacttttcaaatatggacgatgaagagaattattctgcagcaagtaaagcagtccggcaggtactgcaccaactaaagagacttggaattgtgtggcaggatgtcctgccagtgaatatatattgcaaggctatggggactttactcaatacagcaatttctgaggtcattggcaaaattactgccctagaggacatatctactgaagatggtgataggttatattccttatgcaaaacagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtgggcagatggaaaaggacccctggcagctgcgttctcttccagtgaagtaaaagctttaattcgtgccttgtttcagaacacagaaagaagagcagctgcccttgctaaaattaaatagctccatcttcttaagaaagctatgtcttgaatatgtggattcttcccttggcataattactcccttaaagacttctttgaatcgcccattggttttggtgaaccagtacatcttggaagtttgactttacagaagaacgtcttacctcctggcctgtacgaggctttgtttaagaactgtttattaagataaattgtcaagtaaagcacctcaattcattgactttctagccatcttcctttgattagctaacaaactgtcaggcagcattatttcatgctgcttccagagccctctgggagctatatacattgtaaatgcaggccctagctttggaacgaggaattgggagattccaggagtcagggtagagaatttctgagcaaatcggagatattttaggggtgtggaggaggggaagggaggaatgggccaccatatttggccttacaggaattaaggagacttcctgtaatatttctttccaataaatattgctttttacaaataagg

SEQ ID NO: 31011 - DNA, 671 bp, Homo sapiens
gacgggagctgcggcgctggctacgagagtgacccagtcagcgttggttcccgtcttggccatggcctcgttcgtgacagaagttttggcacactccgggaggctggaaaaggaggatctggggacccggatcagccgcctgacccggcgggtggaggagatcaagggtgaggtgtgcaatatgattagcaagaagtacagtgaattcctgcctagcatgcagagcgcgcagggcctgattacccaggtggataagctatctgaagacattgacctgctgaaatccaggatagagagtgaggtccgccgggatcttcacgtatcaaccggtgaatttacagacttaaagcagcagttggaaagagactcagttgtcctaagtttgcttaaacagttgcaggagttttccactgctattgaagaatataattgtgcattaacagagaagaagtatgtcactggtgctcagcgtctggaagaggcacagaaatgcttgaagttattaaaatccagaaaatgctttgatttaaaaatattgaaatctctcagcatggagctcacaatacagaaacagaacatactttatcaccttggagaagagtggcagaagctgattgtatggaagttcccaccatcaaaaggtgctgctgacctcaggtggactgctttgc

SEQ ID NO: 31012 - DNA, 2574 bp, Homo sapiens
gacgggagctgcggcgctggctacgagagtgacccagtcagcgttggttcccgtcttggccatggcctcgttcgtgacagaagttttggcacactccgggaggctggaaaaggaggatctggggacccggatcagccgcctgacccggcgggtggaggagatcaagggtgaggtgtgcaatatgattagcaagaagtacagtgaattcctgcctagcatgcagagcgcgcagggcctgattacccaggtggataagctatctgaagacattgacctgctgaaatccaggatagagagtgagataccagcagtttggaatcttacctacaaactgaacttcatttatacactgaacaatcgcacaaagaggagaagacccctatgccacccatcagttctgtcctcttggcattttctgttcttggagaactacacagcaagcttaaatcatttggtcagatgctgctgaagtatatccttaggccgctggcatcttgcccatcccttcatgctgtgatagaaagccagcctaacatagttattattcgttttgaatctataatgactaacttggaatatccatcaccatctgaagtttttacaaagatcagactggtactagaagtgctccagaaacagcttctagatttgccacttgacactgacctggaaaatgaaaaaacatctactgtcccattggctgagatgcttggagacatgatctgggaggacttgtctgagtgcctcatcaaaaactgtttggtttattcgattccaacaaatagcagcaaattacagcaatatgaagagatcatacagtccactgaagaatttgaaaatgccctaaaggaaatgagatttttaaaaggagatactacagatttgctgaaatacgctcgtaacatcaattctcattttgcaaacaaaaagtgccaggatgtgattgtggcagccagaaatctaatgacctcagaaattcataacactgtgaagattattcctgattctaagataaatgtgccagagttacccactcctgatgaggataacaaactggaagtacagaaagtatccaatactcagtaccacgaagtgatgaatttagagcctgaaaatacattggaccaacattccttttccttgcccacatgccgtatcagtgagtctgtgaagaaattaatggaactcgcctatcagactttactagaggcaacaaccagtagtgatcaatgtgctgttcaacttttctactcagtgaggaatatcttccatttgttccatgatgttgtaccaacatatcacaaggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacctggcttcaggagacttgggacagaatgctttttggcccaaatgcgggcacagaaaggtgaacttctggaaagattatcaagtgctaggaacttttcaaatatggacgatgaagagaattattctgcagcaagtaaagcagtccggcaggtactgcaccaactaaagagacttggaattgtgtggcaggatgtcctgccagtgaatatatattgcaaggctatggggactttactcaatacagcaatttctgaggtcattggcaaaattactgccctagaggacatatctactgaagatggtgataggttatattccttatgcaaaacagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtgggcagatggaaaaggacccctggcagctgcgttctcttccagtgaagtaaaagctttaattcgtgccttgtttcagaacacagaaagaagagcagctgcccttgctaaaattaaatagctccatcttcttaagaaagctatgtcttgaatatgtggattcttcccttggcataattactcccttaaagacttctttgaatcgcccattggttttggtgaaccagtacatcttggaagtttgactttacagaagaacgtcttacctcctggcctgtacgaggctttgtttaagaactgtttattaagataaattgtcaagtaaagcacctcaattcattgactttctagccatcttcctttgattagctaacaaactgtcaggcagcattatttcatgctgcttccagagccctctgggagctatatacattgtaaatgcaggccctagctttggaacgaggaattgggagattccaggagtcagggtagagaatttctgagcaaatcggagatattttaggggtgtggaggaggggaagggaggaatgggccaccatatttggccttacaggaattaaggagacttcctgtaatatttctttccaataaatattgctttttacaaataagg

SEQ ID NO: 31013 - DNA, 2861 bp, Homo sapiens
gacgggagctgcggcgctggctacgagagtgacccagtcagcgttggttcccgtcttggccatggcctcgttcgtgacagaagttttggcacactccgggaggctggaaaaggaggatctggggacccggatcagccgcctgacccggcgggtggaggagatcaagggtgaggtgtgcaatatgattagcaagaagtacagtgaattcctgcctagcatgcagagcgcgcagggcctgattacccaggtggataagctatctgaagacattgacctgctgaaatccaggatagagagtgaggtccgccgggatcttcacgtatcaaccggtgaatttacagacttaaagcagcagttggaaagagactcagttgtcctaagtttgcttaaacagttgcaggagttttccactgctattgaagaatataattgtgcattaacagagaagaagtatgtcactggtgctcagcgtctggaagaggcacagaaatgcttgaagttattaaaatccagaaaatgctttgatttaaaaatattgaaatctctcagcatggagctcacaatacagaaacagaacatactttatcaccttggagaagagtggcagaagctgattgtatggaagttcccaccatcaaaagataccagcagtttggaatcttacctacaaactgaacttcatttatacactgaacaatcgcacaaagaggagaagacccctatgccacccatcagttctgtcctcttggcattttctgttcttggagaactacacagcaagcttaaatcatttggtcagatgctgctgaagtatatccttaggccgctggcatcttgcccatcccttcatgctgtgatagaaagccagcctaacatagttattattcgttttgaatctataatgactaacttggaatatccatcaccatctgaagtttttacaaagatcagactggtactagaagtgctccagaaacagcttctagatttgccacttgacactgacctggaaaatgaaaaaacatctactgtcccattggctgagatgcttggagacatgatctgggaggacttgtctgagtgcctcatcaaaaactgtttggtttattcgattccaacaaatagcagcaaattacagcaatatgaagagatcatacagtccactgaagaatttgaaaatgccctaaaggaaatgagatttttaaaaggagatactacagatttgctgaaatacgctcgtaacatcaattctcattttgcaaacaaaaagtgccaggatgtgattgtggcagccagaaatctaatgacctcagaaattcataacactgtgaagattattcctgattctaagataaatgtgccagagttacccactcctgatgaggataacaaactggaagtacagaaagtatccaatactcagtaccacgaagtgatgaatttagagcctgtctgtgaagaaattaatggaactcgcctatcagactttactagaggcaacaaccagtagtgatcaatgtgctgttcaacttttctactcagtgaggaatatcttccatttgttccatgatgttgtaccaacatatcacaaggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacctggcttcaggagacttgggacagaatgctttttggcccaaatgcgggcacagaaaggtgaacttctggaaagattatcaagtgctaggaacttttcaaatatggacgatgaagagaattattctgcagcaagtaaagcagtccggcaggtactgcaccaactaaagagacttggaattgtgtggcaggatgtcctgccagtgaatatatattgcaaggctatggggactttactcaatacagcaatttctgaggtcattggcaaaattactgccctagaggacatatctactgaagatggtgataggttatattccttatgcaaaacagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtgggcagatggaaaaggacccctggcagctgcgttctcttccagtgaagtaaaagctttaattcgtgccttgtttcagaacacagaaagaagagcagctgcccttgctaaaattaaatagctccatcttcttaagaaagctatgtcttgaatatgtggattcttcccttggcataattactcccttaaagacttctttgaatcgcccattggttttggtgaaccagtacatcttggaagtttgactttacagaagaacgtcttacctcctggcctgtacgaggctttgtttaagaactgtttattaagataaattgtcaagtaaagcacctcaattcattgactttctagccatcttcctttgattagctaacaaactgtcaggcagcattatttcatgctgcttccagagccctctgggagctatatacattgtaaatgcaggccctagctttggaacgaggaattgggagattccaggagtcagggtagagaatttctgagcaaatcggagatattttaggggtgtggaggaggggaagggaggaatgggccaccatatttggccttacaggaattaaggagacttcctgtaatatttctttccaataaatattgctttttacaaataagg

SEQ ID NO: 31014 - DNA, 1528 bp, Homo sapiens
ctcagcctcccgagtagctgggattaaaggtgcccatcaccacatccgcctaatttttgtattttcagtagagatggggttttgccatgttggctaggctggtcttgaactcctgacctcatgtgatctgccttcctcggcctcccaaagtgttgggattacaggtgtgagccaccactcctggcctgaaatccattcttgatggtatgtgtagctgcagttcattttcaccatcgcatcattccattgtacaaatatttcatagtttatttgtcctgtttagtctcattttcaccagtatttggaattatcagactggaaagtttcagctgatctaattggcatgcaatgataggttattgtcattttaatttgcatttccctaaattctaatgatgttgagcatcttttcattggtcattcatgtttcttctattatgtaatgcctgttcatatttttttgcccgttattctaataggttgtttgtggtttcactattgattcatgggacttctttatatatttttgtactagtccttcatcagttaaaattggttgcctgtggttactttgtaatacagttataaagcctaaggcatgagagtatggtcatcattattagttcaaagaggccttggtatagaataagggagaatagtctcatattcctcacttggtctcttcatctggctgtgctgataaccagttgtagtgggtgagcaaagaggtcagacacattgaggggcagttctataaagaagaggaaagatgcccaggatttgttttatttccatttcaagcaaataagcatttggatcaaacaggcaatttttaagtcttgcttatacttcagagacctaataggaaatggaactctatctttcgttttgcaggtgggcagatggaaaaggacccctggcagctgcgttctcttccagtgaagtaaaagctttaattcgtgccttgtttcagaacacagaaagaagagcagctgcccttgctaaaattaaatagctccatcttcttaagaaagctatgtcttgaatatgtggattcttcccttggcataattactcccttaaagacttctttgaatcgcccattggttttggtgaaccagtacatcttggaagtttgactttacagaagaacgtcttacctcctggcctgtacgaggctttgtttaagaactgtttattaagataaattgtcaagtaaagcacctcaattcattgactttctagccatcttcctttgattagctaacaaactgtcaggcagcattatttcatgctgcttccagagccctctgggagctatatacattgtaaatgcaggccctagctttggaacgaggaattgggagattccaggagtcagggtagagaatttctgagcaaatcggagatattttaggggtgtggaggaggggaagggaggaatgggccaccatatttggccttacaggaattaaggagacttcctgtaatatttctttccaataaatattgctttttacaaataagg

SEQ ID NO: 31015 - DNA, 2446 bp, Homo sapiens
gacgggagctgcggcgctggctacgagagtgacccagtcagcgttggttcccgtcttggccatggcctcgttcgtgacagaagttttggcacactccgggaggctggaaaaggaggatctggggacccggatcagccgcctgacccggcgggtggaggagatcaagggtgaggtgtgcaatatgattagcaagaagtacagtgaattcctgcctagcatgcagagcgcgcagggcctgattacccaggtggataagctatctgaagacattgacctgctgaaatccaggatagagagtgaggtccgccgggatcttcacgtatcaaccggtgaatttacagacttaaagcagcagttggaaagagactcagttgtcctaagtttgcttaaacagttgcaggagttttccactgctattgaagaatataattgtgcattaacagagaagaagtatgtcactggtgctcagcgtctggaagaggcacagaaatgcttgaagttattaaaatccagaaaatgctttgatttaaaaatattgaaatctctcagcatggagctcacaatacagaaacagaacatactttatcaccttggagaagagtggcagaagctgattgtatggaagttcccaccatcaaaagataccagcagtttggaatcttacctacaaactgaacttcatttatacactgaacaatcgcacaaagaggagaagacccctatgccacccatcagttctgtcctcttggcattttctgttcttggagaactacacagcaagcttaaatcatttggtcagatgctgctgaagtatatccttaggccgctggcatcttgcccatcccttcatgctgtgatagaaagccagcctaacatagttattattcgttttgaatctataatgactaacttggaatatccatcaccatctgaagtttttacaaagatcagactggtactagaagtgctccagaaacagcttctagatttgccacttgacactgacctggaaaatgaaaaaacatctactgtcccattggctgagatgcttggagacatgatctgggaggacttgtctgagtgcctcatcaaaaactgtttggtttattcgattccaacaaatagcagcaaattacagcaatatgaagagatcatacagtccactgaagaatttgaaaatgccctaaaggaaatgagatttttaaaaggagatactacagatttgctgaaatacgctcgtaacatcaattctcattttgcaaacaaaaagtgccaggatgtgattgtggcagccagaaatctaatgacctcagaaattcataacactgtgaagattattcctgattctaagataaatgtgccagagttacccactcctgatgaggataacaaactggaagtacagaaagtatccaatactcagtaccacgaagtgatgaatttagagcctgaaaatacattggaccaacattccttttccttgcccacatgccgtatcagtgagtctgtgaagaaattaatggaactcgcctatcagactttactagaggcaacaaccagtagtgatcaatgtgctgttcaacttttctactcagtgaggaatatcttccatttgttccatgatgttgtaccaacatatcacaaggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacctggcttcaggagacttgggacagaatgctttttggcccaaatgcgggcacagaaaggtgaacttctggaaagattatcaagtgctaggaacttttcaaatatggacgatgaagagaattattctgcagcaagtaaagcagtccggcaggtactgcaccaactaaagagacttggaattgtgtggcaggatgtcctgccagtgaatatatattgcaaggctatggggactttactcaatacagcaatttctgaggtcattggcaaaattactgccctagaggtaagggccattagatgctacactagccttgagatgcaattcatgtcccagattgtgactttgctaagaaagtgatgttgaagaaattgttcatgtttcatgtctaactcatgctgtttttttttttttcagttttgttttatatctgttttgctagaaactgtttaatctcttttatatgaaagtaggattgaactatttctcagcctaccatctagattataaatgaggaagttagaaactgggtagtggtcctgagatgcgttgtatagtgtaaagtcatttaatttgcaagtaaactcaataatttgatttagtaaagtgaatgcagtcttgtgcaggttccatttttccaacacactgttgcag

SEQ ID NO: 31016 - DNA, 1268 bp, Homo sapiens
gacgggagctgcggcgctggctacgagagtgacccagtcagcgttggttcccgtcttggccatggcctcgttcgtgacagaagttttggcacactccgggaggctggaaaaggaggatctggggacccggatcagccgcctgacccggcgggtggaggagatcaagggtgaggtgtgcaatatgattagcaagaagtacagtgaattcctgcctagcatgcagagcgcgcagggcctgattacccaggtggataagctatctgaagacattgacctgctgaaatccaggatagagagtgaggtccgccgggatcttcacgtatcaaccggtgaatttacagacttaaagcagcagttggaaagagactcagttgtcctaagtttgcttaaacagttgcaggagttttccactgctattgaagaatataattgtgcattaacagagaagaagtatgtcactggtgctcagcgtctggaagaggcacagaaatgcttgaagttattaaaatccagaaaatgctttgatttaaaaatattgaaatctctcagcatggagctcacaatacagaaacagaacatactttatcaccttggagaagagtggcagaagctgattgtatggaagttcccaccatcaaaagataccagcagtttggaatcttacctacaaactgaacttcatttatacactgaacaatcgcacaaagaggagaagacccctatgccacccatcagttctgtcctcttggcattttctgttcttggagaactacacagcaagcttaaatcatttggtcagatgctgctgaagtatatccttaggccgctggcatcttgcccatcccttcatgctgtgatagaaagccagcctaacatagttattattcgttttgaatctataatgactaacttggaatatccatcaccatctgaagtttttacaaagatcagactggtactagaagtgctccagaaacagcttctagatttgccacttgacactgacctggaaaatgaaaaaacatctactgtcccattggctgagatgcttggagacatgatctgggaggacttgtctgagtgcctcatcaaaaactgtttggtttattcgattccaacaaatagcagcaaattacagcaatatgaagagatcatacagtccactgaagaatttgaaaatgctattttaggtactttgccattctctttataaatgtgtatttgagtggttctgtatattctatttacttatcatgtgtgaatatgtt

SEQ ID NO: 31017 - DNA, 529 bp, Homo sapiens
tcgtgaagccaataaatgctaacacggagaccagaaataatcctaggagaagtcatgtaaatattgtacatatttgtggaaataacatatatacgaattttagagttgaacttgagcaaagaaacccctgtgacactgagtgggccacctcagcttggcagtgaagcaagtggacaagttggaaacggaatgtctcagctgctcttatctttgtaaaagaccattagtttgcttaaaggcaatattcctttaagatgtttgacagaaataattacaataaacatagttttataatattagaatataaatgtgatatgaaataaataacttctcttgcctgttatcaagaagttggtaataggaagaactaatataaaagacattaaaaatcaggccgggcatggtggctcatgcttgtaattccagcactttgggaggctaagacaggaggataacttgaggccaggagttgtagaccagcctgagcaatatagtgaaacctcatccctaccacaaaataaaaaataaa

SEQ ID NO: 31018 - DNA, 436 bp, Homo sapiens
gatgagcttcattatagttcttaaaataatgactattttagaaaacagtaatcatcttacattttaaatcattggatatttatgtttgttaaatgtggcaaaatagagcatgagagttgtctatgtgaatttattgggcttttgtactatagctttaaaatattcattgctttttatgaattcaaataacaaatagaggcaactgagaaacatttactatgttaagtaagcctgggatgtacagcctgcctggttctcttagcaacagttgttgaggcaacagggcaaaggttgtgctatataaccaggttaactggacaccgtcaggttgctgaacagagcagttcctctcagaagggctgaaggtggcgaggcaacataaatacatctgcaattcattcattgcccatttacactctaggcttgcaatcatctg

SEQ ID NO: 31019 - DNA, 450 bp, Homo sapiens
tccctttttcctcacaacttctacagaagtgctgagaaaaatgacttttctcaatccttggcaggagccatcctcagaaacattaccctttcttaaacctctttttaggtgggaaaattgtaaaatgtttcataagagttcctcctcatgtgcagtcagattaaggcatgtgtgtttaccaggtaggtaatcaaataggcactcactgctcacaaaagagacttaaaatttttatgtttaaaaaaaattattattattattattattattattattattgagacagggtatcactctgtcacccaggctggagccaagatcgcaccattgccctccagcctgggcaacaagagtgcaactccgtctcacaaaaaacacaacaacgcagagactggagccaggcatcggtgccacgcctgcgatcccaccactctgggagtcacaggcagc

SEQ ID NO: 31020 - DNA, 595 bp, Homo sapiens
acataaggaaatttggccctcaaggccaagaattggccacgagggggagacttcttacaatgaaaattcccaggcctccatggccaaaaattatttcttagtaggtcttcagtggaaccttggaatatacatgtttaataattccctcaagtgattcccatgcaagtggaacctcagctgcatcagaagataaacatacaaagaacaataacaaaatgtaaacaatcaacatatgttcctgctgtgatgaaccaagtaagtggaacaacagctttgtattatgataaaagtagagactaaaaggtaggcttgggtttagcatttcttaaatgttaaaatatataaaataagacacatgaacaattggtgaaatcttcccagttaaactcataaccccaagtcatcattagtccattaaaaagtatctagcaacatcgtcctatccccaccataacctggaactacactggaagggtgggaggtatggggtcacgttcttgtcatttggcatataagaaatgttgacttaatggagttcttcttttagggttatgaggactcagtcccctacaacctacttcataaaaaaaaaaaa

SEQ ID NO: 31021 - DNA, 4036 bp, Homo sapiens
ggcggcctagaagatggcggacggcgacagcggcagcgagcgcggcggcggcggtgggccgtgcgggttccagcccgcgtcccgcggcggcggcgagcaagagacgcaggagctggcctcgaagcggctggacatccagaacaagcgcttctacttagatgtgaagcagaacgccaagggccgcttcctcaagatcgccgaggtgggcgcgggcggttccaagagccgcctcacgctgtccatggcggtggccgccgagttccgcgactcgctgggcgacttcatagaacactacgcgcagctgggccctagcagccccgagcagctggcggctggcgccgaggagggcggcgggccgcggcgcgcgctcaagagcgaattcttggtgcgtgagaaccgcaagtactacctggacctcaaggagaaccagcgcggccgcttcctgcgcatccgccaaacggtcaaccgcggcggtggcggcttcggcgcgggccccgggccgggcggcttgcagagcggccagaccatcgcgctgcctgcgcagggcctcatcgagttccgcgacgcgctggcgaagctcatagacgactacggaggcgaggacgacgagctggcaggcggcccgggaggcggcgccgggggcccagggggcggcctgtatggagagctcccggagggcacctccatcaccgtggactccaagcgcttcttcttcgatgtgggctgcaacaaatacggggtgtttctgcgagtgagcgaggtgaagccgtcctaccgcaatgccatcaccgtacccttcaaagcctggggcaagttcggaggcgccttttgccggtatgcggatgagatgaaagaaatccaggaacgacagagggataagctttatgagcgacgtggtgggggcagcggcggcggcgaagagtcagagggtgaggaggtggatgaggattgaaacgggcagcttcccctacaggcctccacccaaccaccatccccttggctagagaattccctttcctgctcatccccagtgagctagtggagagggagcaagggaggccgcagagggaaaaaacaaaacgtaacacagttaagagaaataatcgtaagagaacagtgacggacaacttgagaaaagcagtcaagttccaaggaactgacagcaacctgcaaagaggaaaacagcatctcctcacctgcgtaaaattgtctcagcttctgttgtttctcaactgaggttcgtaaacccatcaggataatccctggagggaatagatccttgcacatccagggcaagaaacatgtccaagttacccagaccattgataacagttgcatttaggttgcacctgggtaatctggcataaaagatctctctaggcctcactgttgcggtgtctatcccttcacctccattgaaatcagcattttggatctaggtcttcatggaatccttgagaagagaggcctttacaattacccagttctgagggttcaggttcacgaaaagaaatgcaacttgggataatcatgaacaggttaaagataagatttcaagaagccatctaagaatacagaaccaaattggatccatttttttaaaaaaatggttttgcatggaacctggaccaaggcaaatgtcttttcttcgcagaattgttttccaggatgccagtggattcagatagcaatgcttggagtagaatccgttactaaaatagtttcaaagttgacaaaaaattttcaaagataaaagcagttttacattgggggttgctgaggtaggcacaagaaaaagtcaggcataaagcacaaggcagactgtttgagtggattggttgctgctcactaaagttgttcccctgatctctaaatatggaggtcattaccaagaaatgctttggtatgaatgagagccagatctccactgtgtgagccagtgaattatggctaattcggctgttacagccactggttggctggattttaaaccataaaacttgaagattacctacaaaagtaacagtgtggctataagcctgagctttaatggatatacatcctcacagaaaagttggaaataaccaaaactgaagtcttaatttaccttcagtttaatctgtggatttgttcaaatactaaagatcctcaggtccagaattccagcatcatttattcttttaaaatttttaagaacttgatccattgtatcagtacctcacaatcagagttggcaaatgatggatgagtgattcaagcagtgcacccggtggaagctgaaatccatctgtgaatggaactgaagtgaacgtgaatatgctgactatatcctggaagcatttttataccatcttgaaatttcaacaaactggcttttgccagttaatccagctgtctttcaagaataaaagttggggttttcaaggatcgcctcttctatattttaaatggattttcagtagaaatgatttttactaatcaagttaatcccaccccatcaaaaggtattcctagaaatgtcatagacctaggtaactttgaattgaatgggagctaacgttctttccaaagttttcaggtattctttgtgtgacaccttctcaaccaggaggcaagtaaccccgcctccacaatcttagtattttttttaaactgcatgcctgccccttatttgagctgcctttttaatttattgcatatcctttttattatcttattttggtattattcaatctatacaatctttttgtatttattgggaaatgagtaatatacaaaaaggttttcatgtatttgtggctgagagggcgggaaataattgtgtacataaaattaggcttttttaaaaaaatagattatgatgcagaatattgttgatcttagattaaaaagtggaagagccacaaacattggtgcccttttcagactatttctctactctcatcatccacagtagaatttttaaacagatttttttaaagcttttcttttaaatttttctccgttgcaaagaatgtttcctaaattgtatgggagcaatagtatttttgatgttttaatgacatccgtatacttgtactgtattttgtactacaaggcagctgtttttcaataatgtcctgctgtatttacctacgtgttttgagtgtctatttctttgctgcggagaacaaattcctaaatagttttagtaaaggagctgagaagctagcattaggtttgcagaaactatttaagtttcaactctgaggcagcaatgaaaatttaagttgcagctattagttgattgctgtaactttttcattttcaaaccatgtacaattcttgtatagaccaacttgttttcttgcttcagtggtggttctgttgctcagctgcagtgagccagttcaattttgcaaaggtgcagtacctctcctttttaaggggttggtttattcttttttctttttgtttggctgaattgcagtaactagccttgcctttctattctgtagaaatgacagggtcttcacaatccttcaccagtggctactaagctataattagctgaatagaaagaatgtggaagtggtctgaggcatatagagtatatgccaagaacactaccatatatggcatcagctttggttaccagagaaattttcttagtcattagaccatgtaacagtaatatatcatatgtaaatctttagatatcaatttgaaaatcctccaaaaaaaggagcaaagaatgcataagctatgtgttggcaaaagtaatttatattaaaattttgacctgcctatgtaagattaagtggtaatgtcatagtggtgggtttttaagtcttaaccaatctctaaggtttgtttctcctgcaagggatggttcatggcctctcttcccactgcaggaagattgcagaaggctgtggattaattgtagcatttcactgatcttcactccagtcactagggacaatagaaacctgcaaaacacagattcattcgtaaatattattaatagcttattaaaggaaatggtctttgttaa

SEQ ID NO: 31022 - DNA, 1002 bp, Homo sapiens
cagcatttccagcttctactagatgtcagtagcaaaccatccttccactagtggcaactgaaaatgcatgtaggcattgatacatggaccccagggagcaaaatcatccctttttaacttgagaatcttgaggggcttttaagaggagactctgattggtaagtcttaaggttgcttttgccctgttccccaggatttagagggaaagatcattgtagatgaactgaagcaagaagttatcagtaccagcagcaaggcagaaccaccccagtgcacctccctggcctggtctgctgatggccaggtaagtgggtctgtcctctcaggtgattctgcttccagttaattttctccctctcattctgttagtatatctagtctgtcagacacaagagcagtgtccttggcataaagtgaaatgacaagccaggttgatgaggatgccctcgtttgccatgccagtgaatgtgtttctgcatcagagggaagactgatgtggaacgcagtggctgtcagccttcaattaataccttaattaatctgaccagttttcaaatgtctggagccttatcaccagctgtttcttcctcaaggaatacataaccaccacttacaagctggctgttgaaatgagagcggtttcttacagtctacccagcgttgtggcacatgcctactggaggctgaggtgggaggatctcttgaactgcaggggcttaaggctgtagtgagccaggatcgcacccctgcactccagcctagacaatggagcaaggtggacggatctcaaaaaaagccacttgggctcaatctagtgagactgcagaatttatgccagcctgacctgtcactgtcatttcttccctgcagactctgtttgctggctacacggacaacctggtgcgagtgtggcaggtgaccattggcacacgctagaagtttatggcagagctttacaaataaaaaaaaaaactggcctggcttttctgacttttaggtttt

SEQ ID NO: 31023 - DNA, 756 bp, Homo sapiens
acccacgcgtccgcggacggcgtgggtcgacccacgcgtccggggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaaactggc

SEQ ID NO: 31024 - DNA, 356 bp, Homo sapiens
actaaattcgcgggcgtgtacaccaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaaactggc

SEQ ID NO: 31025 - DNA, 337 bp, Homo sapiens
gcctactactactactactaaattcgcggccgctcgacggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaaactggc

SEQ ID NO: 31026 - DNA, 411 bp, Homo sapiens
cagcatttccagcttctactagatgtcagtagcaaaccatccttccactagtggcaactgaaaatgcatgtaggcattgatacatggaccccagggagcaaaatcatccctttttaacttgagaatcttgaggggcttttaagaggagactctgattggtaagtcttaaggttgcttttgccctgttccccaggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaaactggc

SEQ ID NO: 31027 - DNA, 787 bp, Homo sapiens
gcattgctgaggagtgtggctgaacatttttgccaggtgcaacagttctgagtgggcagcagtttgaacatgttttaccttgaaagctcaggtaattggcaggtggaattagagggtcctggtgatgacagatggcattgtcagccaatccccaagtgggagtgaggacatgtcctgcaattctgaagggattctctgtcacttggctcttctctttcatatactcagtcacttgactctgtgatcagagccaaatccagggttgtatgagtgatgcaatgagacagagacaaagcccaggaaatgagtctgaccgttgaatgagagtgtttgctaagtctgagaatgacaaactcctccctctcaggggcacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtgagcgtcaagccaaggcaggggctttaccagtcagggtgtgctcccaggtggtcatacactccaagtcctgtggaaagctttgcagatgccctcagttgactctttctcttgtcacatggtctgatgtcccttgtaagtcagcacactgcattggatatgtgttataa

SEQ ID NO: 31028 - DNA, 1675 bp, Homo sapiens
cccgtgttattcggagagggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaaactggcaaaaaaaaaaaaaaaaaaaaaaaaaaaaaaaaaaaaaaaaaaaaaaaaaaaaaaaaaaaaaaaaaaaaaaaaacagaaatgaagagagagaaaacgcaggatagcaaggactgcggaaagccaccacaccgaaagacgcggcggagcgccgacgccccacgcgtgcccggcttcgagaggagaccccataggcttgccagctggctgctttgtgtgcacggggccgcgatcgcccgatctgagtgcgtagacctcattttactcgccgccgatcgcagcctggcgtatgccgaattaactcattcgtcgcgacatgacagacacttccggagctcgtgactcaaagggcgagccgacacaaatgcgtcgtccggggtcaatcgctcgtgcaccctccgtccaccactagcctatcggcgcgtgtcagtacctggcagaaccaggttcgatggatgtgcgcacgacaagctcacagcgacgaggacgacgtatcgtccgtctctccgtcgcccggaattcatcgaggacgaatagagcgaagcggcgacgctgcggtccccgcgcccccctctcccgcacgcc

SEQ ID NO: 31029 - DNA, 1655 bp, Homo sapiens
tcggcacggagggctacctcgctggtaccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaaactggcaaaaaaaaaaaaaaaaaaaaaaaaaaaaaaaaaaaaaaaaaaaaaaaaaaaaaaaaaaaaaaaaaaaaaaaaacagaaatgaagagagagaaaacgcaggatagcaaggactgcggaaagccaccacaccgaaagacgcggcggagcgccgacgccccacgcgtgcccggcttcgagaggagaccccataggcttgccagctggctgctttgtgtgcacggggccgcgatcgcccgatctgagtgcgtagacctcattttactcgccgccgatcgcagcctggcgtatgccgaattaactcattcgtcgcgacatgacagacacttccggagctcgtgactcaaagggcgagccgacacaaatgcgtcgtccggggtcaatcgctcgtgcaccctccgtccaccactagcctatcggcgcgtgtcagtacctggcagaaccaggttcgatggatgtgcgcacgacaagctcacagcgacgaggacgacgtatcgtccgtctctccgtcgcccggaattcatcgaggacgaatagagcgaagcggcgacgctgcggtccccgcgcccccctctcccgcacgcc

SEQ ID NO: 31030 - DNA, 1687 bp, Homo sapiens
tcggcacggagggctacctcgctggtaccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataaggacctctctatcgatgtggagagagcgataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaaactggcaaaaaaaaaaaaaaaaaaaaaaaaaaaaaaaaaaaaaaaaaaaaaaaaaaaaaaaaaaaaaaaaaaaaaaaaacagaaatgaagagagagaaaacgcaggatagcaaggactgcggaaagccaccacaccgaaagacgcggcggagcgccgacgccccacgcgtgcccggcttcgagaggagaccccataggcttgccagctggctgctttgtgtgcacggggccgcgatcgcccgatctgagtgcgtagacctcattttactcgccgccgatcgcagcctggcgtatgccgaattaactcattcgtcgcgacatgacagacacttccggagctcgtgactcaaagggcgagccgacacaaatgcgtcgtccggggtcaatcgctcgtgcaccctccgtccaccactagcctatcggcgcgtgtcagtacctggcagaaccaggttcgatggatgtgcgcacgacaagctcacagcgacgaggacgacgtatcgtccgtctctccgtcgcccggaattcatcgaggacgaatagagcgaagcggcgacgctgcggtccccgcgcccccctctcccgcacgcc

SEQ ID NO: 31031 - DNA, 1093 bp, Homo sapiens
cccgtgttattcggagagggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaaactggc

SEQ ID NO: 31032 - DNA, 825 bp, Homo sapiens
tcggcacggagggctacctcgctggtaccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaaactggc

SEQ ID NO: 31033 - DNA, 1456 bp, Homo sapiens
  misc_feature (1)..(1): n is a, c, g, or t
nctagctgcagacgactctcttaattatcccataagaccatcatcatgtggaaactgaccagggatgagaccaactatggaattccacagcgtgctctgcggggtcactcccacttttctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccgatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaaactggcaaaaaaaaaaaaaaaaaaaaaaaaaaaaaaaaaaaaaaaaaaaaaaaaaaaaaaaaaaaaaaaaaaaaaaaaacagaaatgaagagagagaaaacgcaggatagcaaggactgcggaaagccaccacaccgaaagacgcggcggagcgccgacgccccacgcgtgcccggcttcgagaggagaccccataggcttgccagctggctgctttgtgtgcacggggccgcgatcgcccgatctgagtgcgtagacctcattttactcgccgccgatcgcagcctggcgtatgccgaattaactcattcgtcgcgacatgacagacacttccggagctcgtgactcaaagggcgagccgacacaaatgcgtcgtccggggtcaatcgctcgtgcaccctccgtccaccactagcctatcggcgcgtgtcagtacctggcagaaccaggttcgatggatgtgcgcacgacaagctcacagcgacgaggacgacgtatcgtccgtctctccgtcgcccggaattcatcgaggacgaatagagcgaagcggcgacgctgcggtccccgcgcccccctctcccgcacgcc

SEQ ID NO: 31034 - DNA, 1118 bp, Homo sapiens
cccgtgttattcggagagggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaaactggcaaaaaaaaacggcacgagctcgtgc

SEQ ID NO: 31035 - DNA, 1028 bp, Homo sapiens
cccgtgttattcggagagggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgttatttaacaatgcgccctacgagctgggacaaacc

SEQ ID NO: 31036 - DNA, 1684 bp, Homo sapiens
cccgtgttattcggagagggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccaggtaagtgggtctgtcctctcaggtgattctgcttccagttaattttctccctctcattctgttagtatatctagtctgtcagacacaagagcagtgtccttggcataaagtgaaatgacaagccaggttgatgaggatgccctcgtttgccatgccagtgaatgtgtttctgcatcagagggaagactgatgtggaacgcagtggctgtcagccttcaattaataccttaattaatctgaccagttttcaaatgtctggagccttatcaccagctgtttcttcctcaaggaatacataaccaccacttacaagctggctgttgaaatgagagcggtttcttacagtctacccagcgttgtggcacatgcctactggaggctgaggtgggaggatctcttgaactgcaggggcttaaggctgtagtgagccaggatcgcacccctgcactccagcctagacaatggagcaaggtggacggatctcaaaaaaagccacttgggctcaatctagtgagactgcagaatttatgccagcctgacctgtcactgtcatttcttccctgcagactctgtttgctggctacacggacaacctggtgcgagtgtggcaggtgaccattggcacacgctagaagtttatggcagagctttacaaataaaaaaaaaaactggcctggcttttctgacttttaggtttt

SEQ ID NO: 31037 - DNA, 1370 bp, Homo sapiens
cccgtgttattcggagagggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccaggaatacataaccaccacttacaagctggctgttgaaatgagagcggtttcttacagtctacccagcgttgtggcacatgcctactggaggctgaggtgggaggatctcttgaactgcaggggcttaaggctgtagtgagccaggatcgcacccctgcactccagcctagacaatggagcaaggtggacggatctcaaaaaaagccacttgggctcaatctagtgagactgcagaatttatgccagcctgacctgtcactgtcatttcttccctgcagactctgtttgctggctacacggacaacctggtgcgagtgtggcaggtgaccattggcacacgctagaagtttatggcagagctttacaaataaaaaaaaaaactggc

SEQ ID NO: 31038 - DNA, 801 bp, Homo sapiens
  misc_feature (1)..(1): n is a, c, g, or t
nctagctgcagacgactctcttaattatcccataagaccatcatcatgtggaaactgaccagggatgagaccaactatggaattccacagcgtgctctgcggggtcactcccacttttctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccgatgagagccactcagagtgggtgtcttgtgtccgcttctcgcccaacagcagcaaccctatcatcgtatggaacctggctaactgcaagctgaagaccaaccacattggccacacaggctatctgaacacggtgactgtctctccagatggatccgatggccaggccatgttatgggatctcaacgaaggcaaacacctttacacgctagatggtggggacatcatcaacgccctgtgcttcagcctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaaactggc

SEQ ID NO: 31039 - DNA, 709 bp, Homo sapiens
tctaaagggattctattgagcttaaaggtttgggttcttggtttttgaaaggtgctgccagccatcatcctactgaggggtagggctgggaggtctagcatttcatgggataggactgtttgccctaatttcctttccatcttctgtagatgagagccactcagagtgggtgtcttgtgtccgcttctcgcccaacagcagcaaccctatcatcgtctcctgtggctgggacaagctggtcaaggtgagcgtcaagccaaggcaggggctttaccagtcagggtgtgctcccaggtggtcatacactccaagtcctgtggaaagctttgcagatgccctcagttgactctttctcttgtcacatggtctgatgtcccttgtaagtcagcacactgcattggatatgtgttataatctaacgtgaagtggccaggacatgttactgaatgagaaatggctaccgtatccagaagtgccaagcccttttttgttgggcctgaccctagctcatcaagagctaggatgttcacctgtcaaccgcacgtctatgcgtatggaacctggctaactgcaagctgaagaccaaccacattggccacacaggctatctgaacacggtgactgtctctccagatggatccctctgtgcttctggaggcaaggtatttggggacaaggcgtctcctactcagtggaagacagcgtcatg

SEQ ID NO: 31040 - DNA, 385 bp, Homo sapiens
gaataaaagtcctttttcagatgtgtatttaatgaatattttctcctagtgtgacttttttgttgttcctgtgtttcagagaacagaagaagtttgtaagtttgatgaaactcggttcactttttcgtttttttttttgttttgtttattttgtatcgtgtcaggaatctgtctacctgaagatcataaagttgtttttttttttgttttcacttttaagctctgttggacttgagaaagttttgttttttgggttttttttttcatattctagaagttttgtagttttagcttttatgtttaggtctctgatccatttctagttagtttttatgtatgaggtaagggtgaagattttttaaaaaacttgaggtcccacacctgt

SEQ ID NO: 31041 - DNA, 346 bp, Homo sapiens
gctctaatctttccccactcctttctctcccaagtccagtgactgtcagtccgctgcagtttctccagtgtgacttccatgcctcttctgccatctagcggccactgctggtcctcagcatcattacccacagctacaggccccgcgtcccagccttcatagagatccaactcgacaaacacgtattagctgtccactataagcactgcatgggatgtaaaagtaggcaagcacagcctctttcttcaaagaggttacaatatagtaaaatccattaaactggcgaataatttattgattttgaaaaatcagaacctcatggcaaaggaaatactccaaaaaaaaa

SEQ ID NO: 31042 - DNA, 377 bp, Homo sapiens
tgaagagatccagtggattctcagagctgcatagttggatctcagatttccaagatgtactatatatattgcaaataacaaagtctgctaatgtatttttcatagatgcaatagaacttgcttttatatatacaggagattaaagtttagataattgattattcattacttattgcattctttaaagtagattgtataaaacatttatcctgtttagtagtttatattttgtataaacatatgatattgtagcttttaagaacaaactgggctcatgcctgtaatcccagcactttgggaggccaaggtgggcggatcacgaggtcagcagtttgggaccagcctgaccaacatgatgaaacctctctactaaaaat

SEQ ID NO: 31043 - DNA, 886 bp, Homo sapiens
agagaataatttgtgccaagggacaaaaatcaggacgcaggaatctgctgccaagttcaagggccatatttgttaggaacagaaactaagtagaaaaccaaggatgcctggaatgaaatgagccaagaaaaaaggataagaaccaagcaaaacttgctggaaattgccttggatttaatatagaccattggtcaacatgaaaactgaagatagtgtctgatcatgactttgcaaagtaacagacgaagtgatcttcaggagagaataagatgaggaatttaggaagtatgataaggctttttcatcagacactgcagattgggagaaaatggagctgaccatggacaagttataaatttgcctagcattgataaagtatcagctgaggctgaaaaccaccaattttaacaaaaatcagcatatttcttcagtattgtgtggtgcttatctccttgggagcagaaagcagagactggattaatccaaaatcagggataaactgaccaggaggagcagaggaataatgggccaagagtactgaggatgcaagtaaaagtgctcaaattactgtattgaccttgtaatcccaagctgatcggggaaggaaaaaaaaaaaacaggagagggctggaaaattgtcacaggtaatgacagaggatcagatgtgctatagaaatgtgctgttgaaaatggtagactaagcccctctccaattatactgtggaatgagccgtataacatgttgtgattattggtttctcccttctggacctggagtgtcagttcttctaaagcagagacttccctttaatctctgtttaaacttggtgcctaggacaatgtaatggcatccataaaatatctaatggaatggagtttaacatgt

SEQ ID NO: 31044 - DNA, 763 bp, Homo sapiens
attttagagaagtggcaagacaaaggaaagcaggtttaggctcccaaaggagggacctctgagaagttacctccacgaagcagctcggctggtgccagagagaacatcggtacaggtctgggaatttccctgggagctggccccaagccacagccctccccagctccgtagtttgtttgttcttcctctcctgggctcaatcatctggacaagcctcactgcagggaaaacccctggggagacacagggctgctttcccagcagaaggtcagtgtctgaagagaaactgggggtcccccagggaccagattcggctccggtggtaaggtgccccaggtggcccaggaggagaggttatcttctgggagctcttccaggaaacccgagtccttggagaattcaggtggtgggagagattcttggtgcccatccccacccggcccttggcctggccccttctcagccaaatagccagaggacccagccctgtcccaggaggagtccacagtgctggcccagcttctgtctgaagaatcccaagcagaggagccttcgcttgggaccagaggagccctgggcctccctgagtccaccccaccagcctccgagtgccctggagcctggtgctcttgccccaggaaagaaggcggttcaatgtagggctggaagctgacgccatcttctgtgtcctcctcatcctcctcctcttcgtcctctgcaaggtccttcttccatcttgtctgttgggtggctggggccctga

SEQ ID NO: 31045 - DNA, 1556 bp, Homo sapiens
ccagtcgacttttttttttttctttaaaaatagagctctttatttaaacagtttagggtaataccaacaagcagtaggatatcgtttaaatatgacataaacatagaaaaaatagaaataaatacaaatacataagaacaacatataccgttagtagtctaaagggatacatgttgctttcacctaaggcactaacacttttcacgggatatgcttccagcacaggcccagcccacaccgcgcagttcccacctgctgtgcatgtgaaagggctttgtaaacagttaagtgctgaccacacaaggcaaattattatactgattatcatgccctttccaaatgcttctcctggctttttgtgaatgacttaatgacgataaaggagatggagtttagagttactggaaaacttaagctatgtcagaaattaaactctggaaaaaattctttaaaaaaatagtaaggtttggctgggcgcggtggctcacgcctgtaatcccagcactttgggaggccgaggcgggcggatcacctgaggtcaggagttcgagaccagcctggccaacatggtgaaaccccgtctctactaaaaatacaaaaaaattagccaggtgtggtggcgggtgcctgtaatcccagctacttgggaggctgaggcaggagaatcacttgaacccgggaggtggaggttgcagtgagccgagattgtaccactgcactccagcctaggcaaaaagaacaaaactccgactcaaaaaaacaaaacaaaacaaaaatggtaaggtttaagaatagaaacggagtggttatttcatacaagtctaagatgatgctgatgatagcttttacttttttgaagttacctccacgaagcagctcggctggtgccagagagaacatcggtacaggtctgggaatttccctgggagctggccccaagccacagccctccccagctccgtagtttgtttgttcttcctctcctgggctcaatcatctggacaagcctcactgcagggaaaacccctggggagacacagggctgctttcccagcagaaggtcagtgtctgaagagaaactgggggtcccccagggaccagattcggctccggtggtaaggtgccccaggtggcccaggaggagaggttatcttctgggagctcttccaggaaacccgagtccttggagaattcaggtggtgggagagattcttggtgcccatccccacccggcccttggcctggccccttctcagccaaatagccagaggacccagccctgtcccaggaggagtccacagtgctggcccagcttctgtctgaagaatcccaagcagaggagccttcgcttgggaccagaggagccctgggcctccctgagtccaccccaccagcctccgagtgccctggagcctggtgctcttgccccaggaaagaaggcggttcaatgtagggctggaagctgacgccatcttctgtgtcctcctcatcctcctcctcttcgtcctctgcaaggtccttcttccatcttgtctgttgggtggctggggccctga

SEQ ID NO: 31046 - DNA, 424 bp, Homo sapiens
tttaagaatagaaacggagtggttatttcatacaagtctaagatgatgctgatgatagcttttacttttttgaagttacctccacgaagcagctcggctggtgccagagagaacatcggtacaggtctgggaatttccctgggagctggccccaagccacagccctccccagctccgtagtttgtttgttcttcctctcctgggctcaatcatctggacaagcctcactgcagggaaaacccctggggagacacaggtgtgtgtcgtatgtgtgtatgcatgtgtgtgtgtgtgccccagcagcggtgaaggcctcctgacccttagaaatcctggctgtgaccttcatattttactgacatggacaaggggtcagaggttggcccggctgtgcagagatcgaagctcttacccttggggatgt

SEQ ID NO: 31047 - DNA, 405 bp, Homo sapiens
agcgggaggctgctgtcgcccgaggttcgacgtcctgtggcctaggaacgcgaagtgccaaaccgatcgtgagccaaggccgtctatgaaattccgagttcacacatacacgaagactggaggatcctccccattacagaagaacccttcacttcgcaaggcgattcataatagacttcactcagtagccagcccaactacccaatggaaaatgtactgtccccaaatgattatttcattcattttttcaaggacacagtaattgcgtagaactgtgaggttccctccagtgtgccaagaactgtgctggacttttaggaaactcaaagaaatgagagatcaactctttcccctgaataatttacaatctaattaaagagcacaattcctggaaagctgcaggta

SEQ ID NO: 31048 - DNA, 430 bp, Homo sapiens
aggcccaagaatcagccctccaggacccactaatgctgcagcaagctaaagtaagctgctctggggcctaaaaacagggacacttaatccattgctgccaccaccagggcccaaatactggcttagttgatgtccaagtccccagcaaagcttcaccacagcctcacctaataactactctaagccacctaggaaatcacagataccactgaccctgtgtattgctgagtgtcatacaaagattatactacctcaggtgcccaaaatcaaagccaaagtatgctactcaaccagaaaaaatacatcttcagaataaaattctcccctacaaaagcaatttttaaaaatgggaacaagtgattactataccagatgtgtaattatcaaaggaaggacataaaaaacatgaaaaagcatggaaataggacac

SEQ ID NO: 31049 - DNA, 642 bp, Homo sapiens
ttgagcttcaataccctgactaggaccctgttttcaaaacagcatcattgcacctcacaattgacaaaaccagacaacggtgaaagggacagtgacatggcagacacaaaagctcaacacattatggccactctaaacagagtacaaaaggaagggagtcagtgatgtgtaaaccaaacaatgtgaggggaaaaatattgaataatttctgtcatgaggcactgactacagccaggctctaattgaattaaactcccatttatttgctcaggcctaaacaacaggctgggaggaagaaaaaaaaaaaaaaaaaaaaacttaaggtttgctcaactgttctgaggtaccacctttcctcacccctgtataaatccaccatctgtgctcacaagcacacatgttccctctctcaacaaatgcatggagaccctaccaggcacagaagccaaaaaagcacaaggcacacaaaagctccccaggctgccccaggtctaaaggagcaaaaggggtagaaaagatcttttgctcattgcccaggtgagacggcctggtgcgtcctctcagcctcgacacgcgtcaagtaaaagaaaggttaaaattagaaaattcaatttatttgataatttcccagaataattagag

SEQ ID NO: 31050 - DNA, 406 bp, Homo sapiens
tattttttagatgggattacctttaaattaggagactgaatacagtagattaccctccataatatgcgtggacctcagttaaagatcttaagagagaagactggccaggtgcaataactcacgccccctatatctcaacactttgggatgctgacgtgggacaatcttttgagcccaggagttcgagaccagtccaggcaatgtagcaagactctgtctttacaaaacaacaacaacaacgacaacaacaaaagaattagccaggcatagtggtgcaaacctgcagtcccagctgctcaggaatttgaggcaggaggatttttcaagcccagggatttaaggctgcagctctaatcctgcgtctgcactctagcctaagtgacagactgagactttgtctctaaaa

SEQ ID NO: 31051 - DNA, 388 bp, Homo sapiens
gttctgagtctttgaaaagaatgttaaaggtcaatagtagttggaagaactaagcctgactgtctcccaactcatggttttaccaaaaactctattaaaaaactgttgtgggccgggcacggtggctcatgtctgtaatcccagcactttgggaggccgaggagggcggatctacaaggtcaggagatcgagaccatcctggctggcatggtgaaaccctgtctctactaaaaatacaaaaaaaaaattggccaggtgtggtggtggatgcctgtagtcccagctcctcaggaggctgaggcaggagaatggtgtgaaccctagaggtggagtttgcagtgagctgagattgtgccactgcactccagcctgggtgacatagtgagac

SEQ ID NO: 31052 - DNA, 412 bp, Homo sapiens
atgaggttgttagtgaaacaggacagaggagaagcaaagatctttgtttaatcttagagataagtggcggctcattcttgattctcccagtgagctagagtatcgatgtcaatatattgatatgatcaacattttacggagtgttgattaacattcatttgggttttggaagatttctatttgtttatgttaaataacaaaaacatgaggttgtcaggaaattgttagggagggatgcctttgctgccctgtcaatttccaagcaacagggctgtgttctagcccagggaggctgagctgtagttagaaatgactttctgtgtgcaaaacagaacttggtgaaatacttaaccagtagttaatttgctgcctttgctcaatagattctgaatgccttcaagtagaaatccca

SEQ ID NO: 31053 - DNA, 411 bp, Homo sapiens
gaacctggacattttatagtgccattgagtaaggaagcgcttttaaaaaaatgactggggtatgtcaaagggacatagaagccaagtgaaagagctcccaacagccaaagctgaaataatttgagcaacaaaataaataaaatagtactgattataatccaaagtataaaagaaatatctatcagtccattctaatatagataaatgactaaatgaataaatggagagaagagagaaatctcctatgcagaataatttaataataacttatgtagatattccacccttaaagacatggagcatcactctccactccttatgtgtggactgtacagagtgacctccttctaaagaacacagtatagaaaacagggggggtaggaagagtagctttactgtggaaaagcctga

SEQ ID NO: 31054 - DNA, 2190 bp, Homo sapiens
  misc_feature (1354)..(1354): n is a, c, g, or t
ctccaagggtataccattcctaaaggcacattgatcttacccaacctgtggtcagtacatagagacccagccatttgggagaaaccggaggatttctaccctaatcgatttctggatgaccaaggacaactaattaaaaaagaaacctttattccttttgggatagggaagcgggtgtgtatgggagaacaactggcaaagatggaattattcctaatgtttgtgagcctaatgcagagtttcgcatttgctttacctgaggattctaagaagcccctcctgactggaagatttggtctaactttagccccacatccatttaatataactatttcaaggagatgaagagcatctccaagaagagatggtaaaaagatatataaatacatatccttctaagcagattcttcctactgcaaaggacagtgaatccagcaactcagtggatccaagctgggctcagaggtcggaaggagggtagagcacactgggaggtttcatcttggaggattcctcagcaggatacttcagccattttagtaatgcaggtctgtgatttgggggatagaaaacaaagtacctatgaaacgggatatctggattttacttgcagtggcttccaccgatgggccaatcttctcatttcttagtgcctcagacatcccatatgtaaaatgagagtaataaaacttggcttctctctacctctcagcactaatgatggtcaaatgccttacatcttttctgatatctctaaaatgctgttaagttctggagaagaacttcaggagaagaagatctatcagctggcttttaaagacctatgacaacatgaaagtggtgttcagcctggaatgctttgtcagagatgggtgtggatttaggttatactgggggagaacttttctcagcacagattctatgccagcttctttgggcttgttctgtcactatctttttgtttatgattttagtttttactttttgtagatgtgggatgaagtggactctgtcgtgtatattgaggaaaaaagaaattataattttaaaaaatcccttgtaggattattatctaaatttatatgtctaacttctactacaactacaggaacagtgagccttgctacttctttagtagcttcttggcagaattcctttctactgagttatttgcaaagatgcagctctacctttttacttaaggcctgaatggtgagcatggggattttgatactgggactcatcaggaaaggattctgctttcaaactatactgaacattcctgtcctagcgtccctgccaccaggcccaatgcatctgatccttgaatatactctcaaagaattcactctcnttttattaagagaactaaattgtttctaaatgtagatggtccctctggaaaagcagttttcagcaggggtggtaaccccttcagagggagtttggaaatgtgtgggtatgattcttggttatcataatgatgggggtgctactggccttctgctgccatgggaccaggatgctaaatgtcaaggtagtcctatacagtgaagaattgtcctgctcaagatgccaggatttcccccagtgagaacatgctctaaggaatgaccacccctttcttttattctcccacagtgctccatgtacagaagtaagcatagcagtcatatgagcaaccacattcctgaacctttcctcatgctggctctacacttaatcctttacttgtatgtttctgtaattcttacataaattctattaagagggtggcatactgtagtggatgaagctgaggcttatagtaggtaaggcacaaagttaaaaagtaacatcactgggtttcaaacctactggtctctgtgactaaagaacactttcagaaccacttcttgattctgccaccacttgatcccataacaggctaccccttggcctcatgctggagttgtgtgtgtctgtcttcatcccaggctgagctccttgaggtgaggatgttgtgctgtttgcctccctcacagtgccttggtcttagtggatgcccagttgtcttgtgaatgacttttaagaagtgtacttaagagaaaaatcctaccttatttgaataattacaagtcatgtttttgttgcttaaaggtgataaatcagtgtatattatttgttaatgtccattaaagccagttttta

SEQ ID NO: 31055 - DNA, 3458 bp, Homo sapiens
  misc_feature (1354)..(1354): n is a, c, g, or t
ctccaagggtataccattcctaaaggcacattgatcttacccaacctgtggtcagtacatagagacccagccatttgggagaaaccggaggatttctaccctaatcgatttctggatgaccaaggacaactaattaaaaaagaaacctttattccttttgggatagggaagcgggtgtgtatgggagaacaactggcaaagatggaattattcctaatgtttgtgagcctaatgcagagtttcgcatttgctttacctgaggattctaagaagcccctcctgactggaagatttggtctaactttagccccacatccatttaatataactatttcaaggagatgaagagcatctccaagaagagatggtaaaaagatatataaatacatatccttctaagcagattcttcctactgcaaaggacagtgaatccagcaactcagtggatccaagctgggctcagaggtcggaaggagggtagagcacactgggaggtttcatcttggaggattcctcagcaggatacttcagccattttagtaatgcaggtctgtgatttgggggatagaaaacaaagtacctatgaaacgggatatctggattttacttgcagtggcttccaccgatgggccaatcttctcatttcttagtgcctcagacatcccatatgtaaaatgagagtaataaaacttggcttctctctacctctcagcactaatgatggtcaaatgccttacatcttttctgatatctctaaaatgctgttaagttctggagaagaacttcaggagaagaagatctatcagctggcttttaaagacctatgacaacatgaaagtggtgttcagcctggaatgctttgtcagagatgggtgtggatttaggttatactgggggagaacttttctcagcacagattctatgccagcttctttgggcttgttctgtcactatctttttgtttatgattttagtttttactttttgtagatgtgggatgaagtggactctgtcgtgtatattgaggaaaaaagaaattataattttaaaaaatcccttgtaggattattatctaaatttatatgtctaacttctactacaactacaggaacagtgagccttgctacttctttagtagcttcttggcagaattcctttctactgagttatttgcaaagatgcagctctacctttttacttaaggcctgaatggtgagcatggggattttgatactgggactcatcaggaaaggattctgctttcaaactatactgaacattcctgtcctagcgtccctgccaccaggcccaatgcatctgatccttgaatatactctcaaagaattcactctcnttttattaagagaactaaattgtttctaaatgtagatggtccctctggaaaagcagttttcagcaggggtggtaaccccttcagagggagtttggaaatgtgtgggtatgattcttggttatcataatgatgggggtgctactggccttctgctgccatgggaccaggatgctaaatgtcaaggtagtcctatacagtgaagaattgtcctgctcaagatgccaggatttcccccagtgagaacatgctctaaggaatgaccacccctttcttttattctcccacagtgctccatgtacagaagtaagcatagcagtcatatgagcaaccacattcctgaacctttcctcatgctggctctacacttaatcctttacttgtatgtttctgtaattcttacataaattctattaagagggtggcatactgtagtggatgaagctgaggcttatagtaggtaaggcacaaagttaaaaagtaacatcactgggtttcaaacctactggtctctgtgactaaagaacactttcagaaccacttcttgattctgccaccacttgatcccataacaggctaccccttggcctcatgctggagttgtgtgtgtctgtcttcatcccaggctgagctccttgaggtgaggatgttgtgctgtttgcctccctcacagtgccttggtcttagtggatgcccagttgtcttgtgaatgacttttaagaagtgtacttaagagaaaaatcctaccttatttgaataattacaagtcatgtttttgttgcttaaaggtgataaatcagtgtatattatttgttaatgtccattaaagccagtttttaaaaaaatcactggacttttgtgtttaccatttaaaacaaccattttaaacaaacttagaacgatgccttagctgtttataggtaacagaatgtaaactcccaccacctggagactaggccatatccagggacctcacactgactttcctaaaggagagaagcagctacgctgttcatactgatagagaagagggcaagaaaagatccagagtggctgttactttgaaaattaaacgaaagatgaaattctgaacttaaaacacttctgtttggccttctataactgatcacccttctttgctctgttttccagataaatggagacaccagatctccctaacctctgacttctgccgttagccatactctgtgtagttagatctcagtctgggaatggcattccagggcaattgtgaacatgaggctagatttttcctttgatttagcacattcctaggcagacttttgcaagctcaaaaaatgaaaataatatctgcttaaccaaaacataatcataggaagaagaaaaattttaaaatgattgatttttgactctacattctttatctaccatactgctcttttcctttttagaaatattactaagcactttcagtatagataaatgaaatacaggctaatctttaggtgtcttaggaatttttgctttttgaaaaagaaaagctaatagcctaactgcagaggaactgagtggatggggtagctgctgtatagatttttagatgagatgatacagtgtggattacactgtaccttgggcgggagagtttgttcttgatatggaattcatatgcttttgaattgcactaataactcagcattaacaagtatattactccttaaattatacatgcattttcaatattcctaaccaaatagtttatagcttattgagaagaagtctgttcttggagagatgttgaaattagatgtttattaaactttaaaatataatgccttaagctgtggcactttaaaaacatctttatatataaattgctaaaaggactgttaatgcttttctcagacacattggcattttacaattttgcacatggtttatttgaaatcaaaaaataactatactttgttttataagtctacctaatatctcatttttgattctcatcgttagcacagttttgttgcttttattaaactattttaactgagaaagtgtcatgtctgttttttgttttgatttaaatgtacgcaaaattttgttttaccagatgtcaagttaatgt

SEQ ID NO: 31056 - DNA, 283 bp, Homo sapiens
tctctggctcttttattgttatttcatagtattcttttcctttaacatgtaacgtgctatttattttaataagacgtgcatttaaagctatgatctccctaagaatacaactgaggcttgttcagtgggctcctggaaatcgtctgagaactatcttttaatgtaaatagtataatggaatggttcagcagggtacagtaaaaacacttaggtaatttctcccttaaacatggggtgcttcctttaacttcaagaggtattgtaattaacagtcaccaatttg

SEQ ID NO: 31057 - DNA, 301 bp, Homo sapiens
aatcataatgttaattattataactaggtatcagtaaacagctaagtagcagtgtgatatggatgtgtgtgggtatctgaagaagcaggcattctagccccttctttaaaagaaagatgtttttcaaaattatttaacattcaggagctaaattctccaaattataaagtgacaacaaactatctgaatattctacaattcatgcactctgagatacatatacttttgtgatagaattgctgtgtttttttaacacagccttgaggtaactgaatactccccgatctcattatttctttta

SEQ ID NO: 31058 - DNA, 138 bp, Homo sapiens
tggaaatacaaaggtctgctatactcacgactgtaccctgattctgtgcccaagcttatacaacttgtgtgggctagacctggaatgagagtctaaaaagtctagctctagaatcagctctcttaaaacctacagtat

SEQ ID NO: 31059 - DNA, 217 bp, Homo sapiens
gactatttttgttagtgttagagagtagaacttcacaagttgggagtttgtctttttggcgcctttaaatacctatgaaccagttacacactaactattgttttaatcttgaaataagagcaaggagtagatagtagataggcctgaattcgagtcccagctgtgaccttccaatttgtactatctcactttcccatttataaggtgggaataacaa

SEQ ID NO: 31060 - DNA, 1089 bp, Homo sapiens
  misc_feature (100)..(101): n is a, c, g, or t
  misc_feature (181)..(182): n is a, c, g, or t
  misc_feature (343)..(343): n is a, c, g, or t
  misc_feature (548)..(548): n is a, c, g, or t
  misc_feature (770)..(770): n is a, c, g, or t
  misc_feature (772)..(772): n is a, c, g, or t
  misc_feature (973)..(973): n is a, c, g, or t
atgggaaaagtgaggtgccaggagccccactgtaaattgccggtggtcgggtcgaggggtgaggtggctgcagaaatctgggccgacaggagggcagatnncaggcagcgactttatgtgggccccagggcagtgccgggactcaggcccagctccctggttttggggctactgtggcccnnagggatgggagcttggtctccttacaaatcccatccatgcgtcactacaaacagctctaataattcctgccctgcagtacctgtgcactttaccatatccacaccccccagcatcccaccccactggcaggggctgacagctctggtgctcttgcactctngggcacatggccgcacacccagacccactcgctcatctcagactcataccacactcaggaaggcccctaactggtctaattcccagcagtggccttccccgcacccgcccctcgcccctccccgctctagcttcccgactttcgtggggaaggggcaccggaacgcagggcagctgagaaggaccgggcagaggagagcgacggnccctcccggtgtcagcttcctcgccgcagtcccattaatcacagtgccgcagtccagttggggatcccgggcgcccagggccgcccgcagccccagggacaatgggattatttccggggagagaggccgcctcgggccggggctcaggcggagacgcctccttccctcaatccgtccctcggcacccaaggagcgcctgcggcggccggagacgagtggcanancggacgcgggtggcgcgcgggtggcagggcctggccgacctaattcaattagctgggccgccgccgcctccgtgcgactctgggcccgccgggactccagctctgggcagctgctctttgtgcacgaagaccatgcatatggatgcggttcctcccccttcggcgctcaccccacccacacccacttctggcacctgcggnttgccccgccctcccactccttccccgcgagggaaggcgaccgtggcctccccaggaaagttgggaaactgtggttgcttttgagctccctgtggccgtcttcagagtatgtgtga

SEQ ID NO: 31061 - DNA, 1113 bp, Homo sapiens
atgcagggtgcaaatccggccgcgatgaacgcgagcgccgcctcgctcaacgactcccaggtggtggtagtggcggccgaaggagcggcggcggcggccacagcagcaggggggccggacacgggcgaatggggaccccctgctgcggcggctctaggagccggcggcggagctaatgggtctctggagctgtcctcgcagctgtcggctgggccaccgggactcctgctgccagcggtgaatccgtgggacgtgctcctgtgcgtgtcggggacagtgatcgctggagaaaacgcgctggtggtggcgctcatcgcgtccactccggcgctgcgcacgcccatgttcgtgctggtaggcagcctggccaccgctgacctgttggcgggctgtggcctcatcttgcactttgtgttccagtacttggtgccctcggagactgtgagtctgctcacggtgggcttcctcgtggcctccttcgccgcctctgtcagcagcctgctggccattacggtggaccgctacctgtccctgtataacgcgctcacctattactcgcgccggaccctgttgggcgtgcacctcctgcttgccgccacttggaccgtgtccctaggcctggggctgctgcccgtgctgggctggaactgcctggcagagcgcgccgcctgcagcgtggtgcgcccgctggcgcgcagccacgtggctctgctctccgccgccttcttcatggtcttcggcatcatgctgcacctgtacgtgcgcatctgccaggtggtctggcgccacgcgcaccagatcgcgctgcagcagcactgcctggcgccaccccatctcgctgccaccagaaagggtgtgggtacactggctgtggtgctgggcactttcggcgccagctggctgcccttcgccatctattgcgtggtgggcagccatgaggacccggcggtctacacttacgccaccctgctgcccgccacctacaactccatgatcaatcccatcatctatgccttccgcaaccaggagatccagcgcgccctgtggctcctgctctgtggctgtttccagtccaaagtgccctttcgttccaggtctcccagcgaggtctga

SEQ ID NO: 31062 - DNA, 202 bp, Homo sapiens
gccccttctctaggcctagcccaacttccctctcccctctaagggccagcctttggctccttccccaacctatatttgaatgagtggcctcaggctcttgacttcctgcagtccagatccttacttacaacactgaagtgggcagggtttacggatttgggaagctggcccagataattgaatgattcgcctgagagtgtcc

SEQ ID NO: 31063 - DNA, 366 bp, Homo sapiens
gtcacctataagtccagaaagaagcctcagaaggaattaactctaccaatatcttgatctcagacttctagcttccagaactgtgagaaaataaatttctcatttgagccactcagtctgtggtactttcttatggcagtcctagcaaactaacacatcatctgaagcgccacctaacacgtgtaagaacaaaaatgtcctatccttatctctttcttcccctagagcttctcaaaggctccccgtcacccccactgtggaataacgaagattacaaggttcttccctttttcatgacattgctcagaaaaggatggaagagttaaacaaagctttggtaagttgggaggtaaggcaaagggaaga

SEQ ID NO: 31064 - DNA, 504 bp, Homo sapiens
atattatgccaccatctttaagattatatattagatctatgacactgtctttttattcttctcttcctctgtccctgtgggcattgacctggaaatctttctaaataagtattatcacttgtacggcttgcctttattatttgtcctacattcatttattttttaaatggcaaatttcaatctgacactcccctcccacttttttaaaggcacatttctagtgaccagcagtataaaccaactccaacttcagcagttcagctcccctcctagatattaacagaacagtagaagacaatgccaagttaaaagtgtgcttaaacatacatcctaaatgtcactgagctgagatcatgccactgcactccagcctcggcgacagagctagactctttcataaataaatgacgggttgatgggtgcagcaaaccatcatggcacgtgtatacctatgtaacaaacctgcatgttctacacatgtatcccagaacttaaagtataata

SEQ ID NO: 31065 - DNA, 468 bp, Homo sapiens
atcaatatcacctaacacatcgtatataagatataacatgatagatagttggtcgattacattgctatactgcttagttttaactggtttatttttattgtagcagaaatgaactgaaaaaaaatatgggtttgataatccacacacatgaaagtacccattttgtaactcaacaaaagataaaacattcttcatcaaaaggcttctcgcttggtgtcaggttgtcacatgtgaccactgtgcaatgcgaagccatacttcttcagtgcacaaagtcatgtttaaacttggaaaagaggatgctacagtagtttcaaagttcagtgttgtggacccaggaaattttccataagtcttgcttgataacaatgtgattgtacaaaataaatgttcttaaggaaacaacttatgtaacatttgctacctttatgtaaacataaataaatcccatttaaaagataaaactta

SEQ ID NO: 31066 - DNA, 416 bp, Homo sapiens
ccaacctccagagggcctgcaacctcactggcttaatcaagctccacttccacctgaggaggagtcctgggtctgaggcacatgagcgtgttgggtaggagggaagcaaaaaggatggccatgtatacactggattcacagctgcgggaacagaagggatgttccctcacctccacacagggccttgggcaggagtgggtcagaagacaaatatagactccatctgctcatctgagcaaaggggcaacccactgctctcactccaactccagaggtaggccaggggcagtaggaccatcctgtatctcattactctcccctagaacggctcaccacactcctggcctctggcccctggccatgcccacctgtttccataactcccataagttattaaatgcatgtgattctgccct

SEQ ID NO: 31067 - DNA, 336 bp, Homo sapiens
aattttttttgtagagatgaggtctccctatgttgtccaggctgggcttaagcaattcttctgccttgtcctctcagagtgcagggattatagatgtgagccacagagctcagtcaggatcactttaacagatgaaactgaatcttagagaagttaagtaactcttgccaaggtttcatagccagcaggtggcagagcctggattccaacccaggtaatttagtctagagctcttattcttaactactttactgtcctaagagtatgcgaatgtacagaaatggagccttgctacctctggtaacttgaaggcaccaattttgcgttcagttaaca

SEQ ID NO: 31068 - DNA, 948 bp, Homo sapiens
atggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattga

SEQ ID NO: 31069 - DNA, 391 bp, Homo sapiens
tgtctctaaaagaaatgtatttaaacaggagagaccaaggcccctgagagaggttgaaggactggggatgactgcccaggttggggggagctggggatgaaggggcagggcagggcatggcacctgtcaccacacacatgaatgaccacaaagaagatgagaaactagactagtttgtgcacctcgtggatccgcactacaacaggtagggttggtgttcaagaagagcagcagggcctcggggtaagaatgtactttctgaagaacggagcttttcaacaccaaaaagcaggacgctttgagcagcagctcccatccctaggggagcttgcagggctgactggatggcagcagcaggtggggttttttgagtggattcacctcctggctg

SEQ ID NO: 31070 - DNA, 473 bp, Homo sapiens
acgcaagccttcactcctgtggctagggcaggaggataggacaggaggaatatcatccagttatggggaacatctatcatgccttatatgtttagagaacatttaagttccctagggaagtctttctctgtgtcttcagcaactttggtatctgatcactataacagggtaataggctggaattttctttttctttttttttttcttgagacagagtctcgctcagttacccaggctggagtgcggtggtgtgatctcagctcactacaagctccgcctcccgggttcatgccattgtcctgcctcagcctctcgagtagctgggactacaggagcctgccaccacgcccggctaatttttttgtactttttagtagagacggggtttcactgtgttagccaggatggtctcaatctcctgacctcttgattcgcccgcgttggcctcccagaatgctgggattacaggcgtg

SEQ ID NO: 31071 - DNA, 343 bp, Homo sapiens
tcttaggttgagataaaaggttctatcaccattttttttttcctactaccattcttgatgttaaatctccgctgaggccactggaaaataacaaaagggctttacagatgaaacacagggctgtgaggcctgatatttttcttagcaaataaacactggacagaaagtagttcagagtgtaagaagtgcctgaccaaaggcctgatgcgcagctttaaaataaattatagaaataattacaaatgctgtaatcaaccataatttacatattagtacatgtatactaagtataaagcttcctaaagtgaagagagcaacacagtaattcataactcaaaaaaga

SEQ ID NO: 31072 - DNA, 468 bp, Homo sapiens
gcattgcgtggcgtagagagtacgtgttcggaaaccagagagatctgagcagaaatcccacacgggaccaagaggctgtatggctgggcctgggcccactcactgagatgctgcgagtctcacttttctcatctgcaaaatagtgataaggctacttctgcagggctgctgtgaagataagaggggaaaaatatgtccagccccaagagcaatgccttgcacactgcatgtggctgagcaaaggggtgaagaatatccaatagtatagacttgcccatttatgaactaagaccaagtaattctgcccctcctccttacatggataactgatctacctttagaaggcctacaaacaggccgggcatgggggtcacgcctgtaattccagcactttgggaggccgaggcgggagaactgcttgggcccaggagtttgagactagcctaggccatgtggagagaccctatc

SEQ ID NO: 31073 - DNA, 418 bp, Homo sapiens
gattctcctgcctcagcctcccaagtagctgggatcacaggtgcccgccaccatacctggctaattttttgtatttttagtagatacaaggtttctccatgttggccaggctagtcttgaacacctgacctcaagtgatccatctgcctcagccttccaaagtgctgggattacaggcatgaccaactgcactcagcccaataaatatgttctataatacgctacttaatgatacctattacattatattgtatggaagttccattacttacttaatctgttcttcctggacatctgatttttctttattgtaaaatgtgacatcttaaacatctttacatattcatcttcttccacgtctttgattacatcctttgtatagctcttagtagtgtttttgctgggtcaatgtttttgt

SEQ ID NO: 31074 - DNA, 427 bp, Homo sapiens
gtcagacttgtggatacatacttactgtttggccttgagcgggaacctccatccctctgagtctttgtttcctcatttgtaaagtgaggaggaagagaaaagcctttcccagcttctcaggatggcacccgggtacagatcatagagatgatgcatgaggcatgctttgtgaacttgaaagtgctgagcagtacttggtcattttaaaacaatgacatcttctttgaataattcttaaatcctggtacagaattaagaaaggatcatctattcaattagtcaactatttgttcaagaaatatgtactgagccttccattatgtgccaggtacttctaagcaataactaagacagacatggattgcctgtcatgaaatgtcaattctagagtaggaggcagagaatagggaagaaaggacgggaggag

SEQ ID NO: 31075 - DNA, 1190 bp, Homo sapiens
cagctacttgggaggctgaggcaggcaggagttcaaggctgcagtgagctgtctgtgccacggcactccaacctgggcaaaagaggagacctcatctaaagaaaaatccaccaaaaaccctgtgttttaaagtgcaaactgatgatggaggaatgggtaaattccaggggtctatatttccaaaaggacatgtgtttttgtgcactaatacttgtttttgaagaacacatctcagtgttaagtggctgttgctgaggaaggggactgaggaactgggtgtgtctgtgtcattctgtttgaatgtctgtcaggggtatagaaactaggagggagacttgtacttttcactttttaaacttcctgtaaaatttgaattttccaagcaagaatattacttttgcttatttaatgtcaacggaattatatgtggatggtggggtggagctaaggattactctactctggctatcccaaaaaaagctccatttgtttaaaaaaattaagtaaatcaaacacagctaattgaggacccttattgtttaatgtgagtgattgtagtgaaaacacttattttagtgtgtataacactagtgaaattatttttgtagttaaatctgctggaagtgtgctattaagcttttattgtttggagccctcaggaaactaatttttctgaataaccacattttccaaatgattaagagctcatccttttaagcaatgaaacttttaaaaggtctttatcaaaaatttttcataaatgttacattcttaaatggtatatgataaataatcatcttttttgttggtttatttttttattttttattttattttattttttgagacggagtctcgctctgtctccaggctggagtacagtggcgcaatctcggctcactgctgcctccgcttcctgggttcaagtgattcttcctgcctcactactcagaaggctgaggtgggagtattgatcgagcccaggaggtcaaggctgcagcaagctgtcgcaccactgcactctagcctgggcaacagcaagaccctcgtctcaaaaaagaaaaaaaaaaagtacaatttttgtattgattatgtattccttaagtaggagtggaataaaagtattttaccgtggattggcttctgtgaaggaaagaagtgaatattagtagatatttggaaaaaagaaa

SEQ ID NO: 31076 - DNA, 1106 bp, Homo sapiens
attgcttcttcccagactggtcccaagaatgctgtggttggttttgtgtcttttccagcacttttcttacttgctgtcagttgtcaatctcaacaccttgaccaaaatgaactttcttgagtcatttcttctctgtttagctataagattagaattcatactgaaagatttctaggacttttgtattaaggtaggaaagaggaactaggttctgggagaaagactcctttggaataaaattcatgagctttattggttcctttaacagatcttcattgagtttcatgtgccaggcatccaactagtctctgcttttatagttgtcagtctgacagggctctagtatgtgcacaccgtgacacctgttggctgccaggagactgtttggcttatttcctggttcttagcaatattccaggttggcctggagaattccaaaggtaaatatgaaaatgtatacctacaaaagaatttttgctttataggaagaatttgtaggatttattgagatgtaagctacctatatacatcaagtatgtgatatgattgtaaaaagttacagaagtgtgtgagtcatgaagtacctgtgagggaagtttatatattttttcaaactcttttagtaccattttcatccactaggtggaagcaattacagtatgacctgcattaaagacatgtacagttttttggccggctgcagtggctcacacctgtgatctcaacactttgggaagctgagacgggaggattgcttgagcccaggagtttgagaccagcttgggcaacgtgatgaaaccctgtctctacaaataaaaaaaaaattagccaggcatggtggcacaagcctgtggtcccagctactcagaaggctgaggtgggagtattgatcgagcccaggaggtcaaggctgcagcaagctgtcgcaccactgcactctagcctgggcaacagcaagaccctcgtctcaaaaaagaaaaaaaaaaagtacaatttttgtattgattatgtattccttaagtaggagtggaataaaagtattttaccgtggattggcttctgtgaaggaaagaagtgaatattagtagatatttggaaaaaagaaa

SEQ ID NO: 31077 - DNA, 1083 bp, Homo sapiens
cagctacttgggaggctgaggcaggcaggagttcaaggctgcagtgagctgtctgtgccacggcactccaacctgggcaaaagaggagacctcatctaaagaaaaatccaccaaaaaccctgtgttttaaagtgcaaactgatgatggaggaatgggtaaattccaggggtctatatttccaaaaggacatgtgtttttgtgcactaatacttgtttttgaagaacacatctcagtgttaagtggctgttgctgaggaaggggactgaggaactgggtgtgtctgtgtcattctgtttgaatgtctgtcaggggtatagaaactaggagggagacttgtacttttcactttttaaacttcctgtaaaatttgaattttccaagcaagaatattacttttgcttatttaatgtcaacggaattatatgtggatggtggggtggagctaaggattactctactctggctatcccaaaaaaagctccatttgtttaaaaaaattaagtaaatcaaacacagctaattgaggacccttattgtttaatgtgagtgattgtagtgaaaacacttattttagtgtgtataacactagtgaaattatttttgtagttaaatctgctggaagtgtgctattaagcttttattgtttggagccctcaggaaactaatttttctgaataaccacattttccaaatgattaagagctcatccttttaagcaatgaaacttttaaaaggtctttatcaaaaatttttcataaatgttacattcttaaatggtatatgataaataatcatcttttttgttggtttatttttttattttttattttattttattttttgagacggagtctcgctctgtctccaggctggagtacagtggcgcaatctcggctcactgctgcctccgcttcctgggttcaagtgattcttcctgcctcagcttcccaagtagctgggattacaggcgcgtgccaccacgctggctaatttttgtatttttaatagagatggggtttcaccatgttggccaggatggtctcaatctcttgaccttgtgatctgcccaccttggcttccc

SEQ ID NO: 31078 - DNA, 348 bp, Homo sapiens
agccattctcagcatatccatcccacagagaatgtggtgttcctgctgggactcttaccggcagttgttttttgtaaaacggttataattttgctcagatgtaagagccaaacttttttgatgtcagagaagatggagccaaattctgtcattccaccaattattattaaatattacatttattttaaacatcacatgatatatatatttgttttgtggtaaaagtccaagcagagatggaatttagacattaagaaggtgatgcaacataaggatggtagggaataacgtgttattatatgtgaaatttatgctaaatgagattttagctgtttttgccacaaaagc

SEQ ID NO: 31079 - DNA, 516 bp, Homo sapiens
ttgttatttgtaagtacttccaaattctgaaacttaaagcaagcataactcagaaatgggggaaaaaaagatttaaaacattcttgttaactaatgtggtgccatagtagaaatgataactggcaaattctgggaataacaggaaaacagagggatgactgggggctagggaactaaatgagaaaatgaaaagaagaaatggcttgagaactaactggctaaagtacacacatctcaggcagtttatgagagatgatccttgtagcaaagcataagagaagggatcactgaggaaaacggaagcacaaatgtgaattaggaaggatactactgaaaatactggcaaacttcaagacatccatttatagttagaagacagaaataaattaactactaagaatctgttatcagaacactggatatattttatttgctttaacttattcttaggcttccaaaaggcaaatgtaagagagttaattgtttgtatccactcagaactattaataattaagt

SEQ ID NO: 31080 - DNA, 182 bp, Homo sapiens
tgcacctagaagtggtgtctgggtgcaaatgtaagcagtggtggatccagaaataagagctttgtgtaataaggttcttaaaacagtcctttcttacacgtgcccggtgccagaccctcggtcttggccttgttcaggagctgggatatctgcgcttggtgaaaatgaaatgaattcctgac

SEQ ID NO: 31081 - DNA, 479 bp, Homo sapiens
aagatggtacagctcataagcagaaaaactaggaagaccagctaaagggtgactactataatccaagcagggcactgtggtggcttgggcccaacagtgatgccatgatagggagagaagtcagggaaacgggatgcaccctgaggatgaggctgatgggatcttctgatgaaccagctgaatttgagaggggaaggcaggactaagaatgattccttgttggcatttttacagacataaaggataagtttttgcattaacttgggagaactaacatgtttatgatgtccaagaacaacaaatgtatttccagagttcaagtcttctgttccaagtgctcgaatgccctggctagagtgcagtgttgtgatcacagttcactgcaacctcaacctcttgatgacactcccgcctcagcctcccaagtagctgggaccacaggcatgaggcaccatgcccaactattttttttttttttt

SEQ ID NO: 31082 - DNA, 208 bp, Homo sapiens
cttgttgccataagagaaagccattattcattactgaataattgaatgttcaatattcaatcattattttaaggttattatgattagatatgtattaaagccattaaccttgcctagtaggtgctccaaaacagaaaagctcctgggacatcctgggagataggaagtcacatatttatcatataaaacgtgttgccaaaaaaaaaaa

SEQ ID NO: 31083 - DNA, 522 bp, Homo sapiens
taggaatttaatttagactccctcataagaaattttggccccccaggaccaaaaattattcccgggggaagagcagctaaagtccacactgggccttgtcaagggctgttcatcaatttcattgtattaaataagttaacacagttatcacagtgacttttcttttgtcagcaaaaaaagccttctttcctcctatatttccagttccaaggtggtatgtgaccgttctctgctgtcatgctgtcgctgacatttattcctctagtgtggagacggggctgtccatctgcctggtggctgctgaccccctagctagtgaggcgtgaggtgggctccgaaagagccagtgaggaggacaccaagcaggggctcctctgccagcctcttaaaaagaggaggtgctatttggttatgtcatggttccatttggttacatgagttccttctcagacccttctctgtgtgtccaccttggggtgatgtgtgtgcgtgaaccaacctgccgaaaattaaacagacaaa

SEQ ID NO: 31084 - DNA, 501 bp, Homo sapiens
gccaaggactggacatcttgacaccaagaaacatagcaaaatccagtcaaaagtgactttgcaagcagtatgatgaatttctatatggttctccagctccagcattttcttagggaaagcatggccagaaatgcccaagtctgtattttggcaacagcccaagcttctcagactccactggccagttccagatctttaagtaactataataagagccatgctgtctgtctctaaaaagtgaagcatgaatcaaaagtgactttgttttaatttaacagcattgagactgtgaaaggcactggatatgtttaggcacctgtaaacggagaatgtggggtgaaaaaagagaggcatagctgggtgcgatggctcacgcctgtaatcccagcactttgggaggctgaagcaggcagatcacttgaggccaggagtttgagaccagcctggccaacacggtaaaaccccgtctctactaaaaatactaaaaattagctgggtgtg

SEQ ID NO: 31085 - DNA, 957 bp, Homo sapiens
atggcagataaagtgcagactactttattgttcttagcagttggagagttttcagtggggatcttagggaatgcattcattggattggtaaactgcatggactgggtcaagaagaggaaaattgcctccattgatttaatcctcacaagtctggccatatccagaatttgtctattgtgcgtaatactattagattgttttatattggtgctatatccagatgtctatgccactggtaaagaaatgagaatcattgacttcttctggacactaaccaatcatttaagtatctggtttgcaacctgcctcagcatttactatttcttcaagataggtaatttctttcacccacttttcctctggatgaagtggagaattgacagggtgatttcctggattctactggggtgcgtggttctctctgtgtttattagccttccagccactgagaatttgaacgctgatttcaggttttgtgtgaaggcaaagaggaaaacaaacttaacttggagttgcagagtaaataaaactcaacatgcttctaccaagttatttctcaacctggcaacgctgctccccttttgtgtgtgcctaatgtcctttttcctcttgatcctctccctgcggagacatatcaggcgaatgcagctcagtgccacagggtgcagagaccccagcacagaagcccatgtgagagccctgaaagctgtcatttccttccttctcctctttattgcctactatttgtcctttctcattgccacctccagctactttatgccagagacggaattagctgtgatttttggtgagtccatagctctaatctacccctcaagtcattcatttatcctaatactggggaacaataaattaagacatgcatctctaaaggtgatttggaaagtaatgtctattctaaaaggaagaaaattccaacaacataaacaaatctga

SEQ ID NO: 31086 - DNA, 520 bp, Homo sapiens
  misc_feature (2)..(2): n is a, c, g, or t
  misc_feature (21)..(21): n is a, c, g, or t
  misc_feature (27)..(27): n is a, c, g, or t
  misc_feature (49)..(49): n is a, c, g, or t
  misc_feature (78)..(78): n is a, c, g, or t
  misc_feature (161)..(161): n is a, c, g, or t
anaaaaaacggcttgcccggntcctgnaaactcaaaaatgtgccccaanaagaaagtcccccaactgaaggctgtggnccccaactctgcccccggaaaataagctatttgcctgaattcctgggaaggggtggggtgggggtcggaagtgattcaagccnatgccctggacccctgggcttccctctttgcaacacccatggctctccccacacttgttcctggatgcctgccttgttttttaccccaacatgacttgtgtgttttctgtctcaaagttttgcctaaagggataagttgtgggtgcttcattcattcttcttcttcttttgttgagaccttgtctctaaaaaagaaagaaaaataaatgcaaagaaccaaaagcagtccaagcaattttaagaaggaagaacacagaggattcacactactaacactatccaatctcatgacttactaaaatcaggagagtaaaatattggtataaaaatagatagattaatggaacagaacagagtac

SEQ ID NO: 31087 - DNA, 258 bp, Homo sapiens
ggcttgagcccggaagttttaggatgcagtaagctaggactgcgtcactgcactacagcctgccgacagagcaagaccttgtctctaaaaaagaaagaaaaataaatgcaaagaaccaaaagcagtccaagcaattttaagaaggaagaacacagaggattcacactactaacactatccaatctcatgacttactaaaatcaggagagtaaaatattggtataaaaatagatagattaatggaacagaacagagtac

SEQ ID NO: 31088 - DNA, 409 bp, Homo sapiens
  misc_feature (374)..(374): n is a, c, g, or t
cttagcatgatgaaataaacatttttactctctaaatagttttcttaacttttaaatgttaaacctatactgtccttgatttaaattactgtgcccatcaattttgtagctggttattgttactgggtattttgatagtcttcttttttttcttttgtttgctcttgaacaatatcatatgtatctttgtgtatatagctttttgttgttggatactttcatctggatacattcttggaaataggatcattggggttttttgtgccagggtggtatatacactttttttgcctttgatatggccagattgctttttaaaggagtttataatgctaccagcactatataagtgtctactagacaccattgaccantatgcacgccatcattttatgaattgccaaaaaag

SEQ ID NO: 31089 - DNA, 319 bp, Homo sapiens
tgcccgccacccacacttggcctaatttttttgaatttttagtagagacggggattcacccatgttggccagccctggtctcgaactcctgacctcaaatgattcgcccacctcagcctcccaaagtgctgggattacaggcatgagccacctcgcccggcccctaatactttttattgactttactaactgctgtctgttaagtcccaaataacagcagcaacttctgtttacccaattttgtggaaaaacaagtaccttctaggtagattcactcattcctcgtctttttagtttattctaagattcctcaggagat

SEQ ID NO: 31090 - DNA, 1907 bp, Homo sapiens
gtctcctggtggggtgcaaggagccgaggcgagatgggcgtcctgggccgggtcctgctgtggctgcagctctgcgcactgacccaggcggtctccaaactctgggtccccaacacggacttcgacgtcgcagccaactggagccagaaccggaccccgtgcgccggcggcgccgttgagttcccggcggacaagatggtgtcagtcctggtgcaagaaggtcacgccgtctcagacatgctcctgccgctggatggggaactcgtcctggcttcaggagccggattcggcgtctcagacgtgggctcgcacctggactgtggcgcgggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccggacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggcgcagccgtggatctgcgcggccctgctccagcccctgggcggccgctgtccccaggccgcctgccactttgccctccggccccaggggcagtgctgtgacctctgtggagccgttgtgttgctgacccacggccccgcatttgacctggagcggtaccgggcgcggatactggacaccttcctgggtctgcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtggaggaggcacgaggcggcggccccggctggagcgcccctcggcttccgcaacccggtgttcgacgtgacggcctccgaggagctgcccctgccgcggcggctcagcctggttccgaaggcggccgcagacagcaccagccacagttacttcgtcaaccctctgttcgccggggccgaggccgaggcctgagcggccgcctgaccgtcgaccttggggctctccaccccctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatgg

SEQ ID NO: 31091 - DNA, 927 bp, Homo sapiens
gtctcctggtggggtgcaaggagccgaggcgagatgggcgtcctgggccgggtcctgctgtggctgcagctctgcggtgagccgggaccacaccggtgcgggcccggacggtagcggtctgtcaggacccagggccgaggtcgctctaggcctggagggtgaagatcttccgaggagtgggcagggagggctttggagggttgggggcgtgaaactcggccctgcctccctcgtctggcgagtgcgcagcccggaagtgcgcggccagtgcatcgggcggtgcgggagaggagaggaggggctccgggaacctcggccagccccggcctccggcggctcctgccctcgcggtttttccgtctgcgaaatgggcgcggtccccagaacctgccgagagcagcgagtgtgcgcctgcggggctcggcagaccgcctcagcttcccggtccccaagggagcactgagccctcctccgccttcacaccaggccggcgcgtgtccctggcgcccccttccctaaacccctcgcggctccctcaggacaacgcccacccaccacattcagggccggcctgacctggtcctgccgcccccagccccttcttacttctcataccgggttgcgctctgtcgcagctcttcccggcccaggtaggactcctccgggaagccttcctgattccaaggccgagaagaggtctgtgctgccccatcctcctccatgccccagttgtcactgtccttaacaacgctgtcctctgctccagcgccaggcaaactgggggcagtgccgggaggctatctaggcaggcgtcctgcagggcgcgtttgagcgggctctgcaggtatcagtagaagtccgttggagagcgcccgggcagggcgcccacagtctggccgggagggaccagggtctgggtccgggccc

SEQ ID NO: 31092 - DNA, 843 bp, Homo sapiens
gcgtggcgtggcgtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtcacagcaccagccacagttacttcgtcaaccctctgttcgccggggccgaggccgaggcctgagcggccgcctgaccgtcgaccttggggctctccaccccctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatgg

SEQ ID NO: 31093 - DNA, 1654 bp, Homo sapiens
gcgtggcgtggcgtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccggacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggcgcagccgtggatctgcgcggccctgctccagcccctgggcggccgctgtccccaggccgcctgccactttgccctccggccccaggggcagtgctgtgacctctgtggagccgttgtgttgctgacccacggccccgcatttgacctggagcggtaccgggcgcggatactggacaccttcctgggtctgcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtggaggaggcacgaggcggcggccccggctggagcgcccctcggcttccgcaacccggtgttcgacgtgacggcctccgaggagctgcccctgccgcggcggctcagcctggttccgaaggcggccgcagacagcaccagccacagttacttcgtcaaccctctgttcgccggggccgaggccgaggcctgagcggccgcctgaccgtcgaccttggggctctccaccccctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatgg

SEQ ID NO: 31094 - DNA, 2052 bp, Homo sapiens
gtctcctggtggggtgcaaggagccgaggcgagatgggcgtcctgggccgggtcctgctgtggctgcagctctgcgcactgacccaggcggtctccaaactctgggtccccaacacggacttcgacgtcgcagccaactggagccagaaccggaccccgtgcgccggcggcgccgttgagttcccggcggacaagatggtgtcagtcctggtgcaagaaggtcacgccgtctcagacatgctcctgccgctggatggggaactcgtcctggcttcaggagccggattcggcgtctcagacgtgggctcgcacctggactgtggcgcgggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtctgcacacgttgggtctgagcactcaggtgaagtctcttcctcgggctggctccggtggggacccggctgcccgcagacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggcgcagccgtggatctgcgcggccctgctccagcccctgggcggccgctgtccccaggccgcctgccactttgccctccggccccaggggcagtgctgtgacctctgtggagccgttgtgttgctgacccacggccccgcatttgacctggagcggtaccgggcgcggatactggacaccttcctgggtctgcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtggaggaggcacgaggcggcggccccggctggagcgcccctcggcttccgcaacccggtgttcgacgtgacggcctccgaggagctgcccctgccgcggcggctcagcctggttccgaaggcggccgcagacagcaccagccacagttacttcgtcaaccctctgttcgccggggccgaggccgaggcctgagcggccgcctgaccgtcgaccttggggctctccaccccctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatgg

SEQ ID NO: 31095 - DNA, 2076 bp, Homo sapiens
gtctcctggtggggtgcaaggagccgaggcgagatgggcgtcctgggccgggtcctgctgtggctgcagctctgcgcactgacccaggcggtctccaaactctgggtccccaacacggacttcgacgtcgcagccaactggagccagaaccggaccccgtgcgccggcggcgccgttgagttcccggcggacaagatggtgtcagtcctggtgcaagaaggtcacgccgtctcagacatgctcctgccgctggatggggaactcgtcctggcttcaggagccggattcggcgtctcagacgtgggctcgcacctggactgtggcgcgggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccggacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggtgagcgaggccgcagtggagtcgcgggggccgcgcgagggtcgggactgtgcccgggacagggccgctgcgctcccacggtctctcgccggcttgcttctcggaggcatcgcccttctcgctgcggtccgctctggccctccgcgctgaccaccgcccctcgcaccaggcgcagccgtggatctgcgcggccctgctccagcccctgggcggccgctgtccccaggccgcctgccactttgccctccggccccaggggcagtgctgtgacctctgtggagccgttgtgttgctgacccacggccccgcatttgacctggagcggtaccgggcgcggatactggacaccttcctgggtctgcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtggaggaggcacgaggcggcggccccggctggagcgcccctcggcttccgcaacccggtgttcgacgtgacggcctccgaggagctgcccctgccgcggcggctcagcctggttccgaaggcggccgcagacagcaccagccacagttacttcgtcaaccctctgttcgccggggccgaggccgaggcctgagcggccgcctgaccgtcgaccttggggctctccaccccctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatgg

SEQ ID NO: 31096 - DNA, 2221 bp, Homo sapiens
gtctcctggtggggtgcaaggagccgaggcgagatgggcgtcctgggccgggtcctgctgtggctgcagctctgcgcactgacccaggcggtctccaaactctgggtccccaacacggacttcgacgtcgcagccaactggagccagaaccggaccccgtgcgccggcggcgccgttgagttcccggcggacaagatggtgtcagtcctggtgcaagaaggtcacgccgtctcagacatgctcctgccgctggatggggaactcgtcctggcttcaggagccggattcggcgtctcagacgtgggctcgcacctggactgtggcgcgggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtctgcacacgttgggtctgagcactcaggtgaagtctcttcctcgggctggctccggtggggacccggctgcccgcagacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggtgagcgaggccgcagtggagtcgcgggggccgcgcgagggtcgggactgtgcccgggacagggccgctgcgctcccacggtctctcgccggcttgcttctcggaggcatcgcccttctcgctgcggtccgctctggccctccgcgctgaccaccgcccctcgcaccaggcgcagccgtggatctgcgcggccctgctccagcccctgggcggccgctgtccccaggccgcctgccactttgccctccggccccaggggcagtgctgtgacctctgtggagccgttgtgttgctgacccacggccccgcatttgacctggagcggtaccgggcgcggatactggacaccttcctgggtctgcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtggaggaggcacgaggcggcggccccggctggagcgcccctcggcttccgcaacccggtgttcgacgtgacggcctccgaggagctgcccctgccgcggcggctcagcctggttccgaaggcggccgcagacagcaccagccacagttacttcgtcaaccctctgttcgccggggccgaggccgaggcctgagcggccgcctgaccgtcgaccttggggctctccaccccctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatgg

SEQ ID NO: 31097 - DNA, 1883 bp, Homo sapiens
gtctcctggtggggtgcaaggagccgaggcgagatgggcgtcctgggccgggtcctgctgtggctgcagctctgcgcactgacccaggcggtctccaaactctgggtccccaacacggacttcgacgtcgcagccaactggagccagaaccggaccccgtgcgccggcggcgccgttgagttcccggcggacaagatggtgtcagtcctggtgcaagaaggtcacgccgtctcagacatgctcctgccgctggatggggaactcgtcctggcttcaggagccggattcggcgtctcagacgtgggctcgcacctggactgtggcgcgggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtcacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggcgcagccgtggatctgcgcggccctgctccagcccctgggcggccgctgtccccaggccgcctgccactttgccctccggccccaggggcagtgctgtgacctctgtggagccgttgtgttgctgacccacggccccgcatttgacctggagcggtaccgggcgcggatactggacaccttcctgggtctgcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtggaggaggcacgaggcggcggccccggctggagcgcccctcggcttccgcaacccggtgttcgacgtgacggcctccgaggagctgcccctgccgcggcggctcagcctggttccgaaggcggccgcagacagcaccagccacagttacttcgtcaaccctctgttcgccggggccgaggccgaggcctgagcggccgcctgaccgtcgaccttggggctctccaccccctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatgg

SEQ ID NO: 31098 - DNA, 1472 bp, Homo sapiens
gtctcctggtggggtgcaaggagccgaggcgagatgggcgtcctgggccgggtcctgctgtggctgcagctctgcgcactgacccaggcggtctccaaactctgggtccccaacacggacttcgacgtcgcagccaactggagccagaaccggaccccgtgcgccggcggcgccgttgagttcccggcggacaagatggtgtcagtcctggtgcaagaaggtcacgccgtctcagacatgctcctgccgctggatggggaactcgtcctggcttcaggagccggattcggcgtctcagacgtgggctcgcacctggactgtggcgcgggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtcgcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtggaggaggcacgaggcggcggccccggctggagcgcccctcggcttccgcaacccggtgttcgacgtgacggcctccgaggagctggtgagggggctggaggggggaccggggcctcctcggggccgggactcggcgccgaccgccgcctgaccctgtcaccccgcagcccctgccgcggcggctcagcctggttccgaaggcggccgcagacagcaccagccacagttacttcgtcaaccctctgttcgccggggccgaggccgaggcctgagcggccgcctgaccgtcgaccttggggctctccaccccctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatgg

SEQ ID NO: 31099 - DNA, 1411 bp, Homo sapiens
gtctcctggtggggtgcaaggagccgaggcgagatgggcgtcctgggccgggtcctgctgtggctgcagctctgcgcactgacccaggcggtctccaaactctgggtccccaacacggacttcgacgtcgcagccaactggagccagaaccggaccccgtgcgccggcggcgccgttgagttcccggcggacaagatggtgtcagtcctggtgcaagaaggtcacgccgtctcagacatgctcctgccgctggatggggaactcgtcctggcttcaggagccggattcggcgtctcagacgtgggctcgcacctggactgtggcgcgggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttgcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtggaggaggcacgaggcggcggccccggctggagcgcccctcggcttccgcaacccggtgttcgacgtgacggcctccgaggagctggtgagggggctggaggggggaccggggcctcctcggggccgggactcggcgccgaccgccgcctgaccctgtcaccccgcagcccctgccgcggcggctcagcctggttccgaaggcggccgcagacagcaccagccacagttacttcgtcaaccctctgttcgccggggccgaggccgaggcctgagcggccgcctgaccgtcgaccttggggctctccaccccctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatgg

SEQ ID NO: 31100 - DNA, 378 bp, Homo sapiens
ctttgtaaatagggcgaccacatgatttctcatccaaaacacttggctgtgaaaggaggcctattaataattacattgggacaacaggagtgaagtagaatgaatattccccatacttacaaagaatatgattcaatttacacaaaataagagaccaaagaggatttgtcttatttctgttcatcccctcttggcttttaaaacagtgccttgtgcagctaaatgcttattgagattagcaatattaaggctgggcatgatggctcatgcctgtaatcccagcactttgggaagctgaggcaggtagatagcttgagcccaggagttcaagaccagcctaggcaacagggcaaaacccgtctctatttaaaaaaaaaa

SEQ ID NO: 31101 - DNA, 294 bp, Homo sapiens
ctttgtaaatagggcgaccacatgatttctcatccaaaacacttggctgtgaaaggaggcctattaataattacattgggacaacaggagtgaagtagaatgaatattccccatacttacaaagaatatgattcaatttacacaaaataagagaccaaagaggatttgtcttatttctgttcatcccctcttggcttttaaaacaatgaaaattcccttagacaaccaggccatccaaatcttcagatatttttctgacaattttctgattctgtattctactacctgcctcta

SEQ ID NO: 31102 - DNA, 224 bp, Homo sapiens
aaaactgtagcccagggcattgaaaacctctcggagagggccaggtgtgaccagccctgtgcccatcctgctgtgattcaggagtctcgcagaagacatcagaatgcctttctctgagtcacagtctgtatcttctagaaaaggctgtccatcttcaccccaagcccactggctcctgagatacgacatccagacccagtgcagctggacctggcccaggtaag

SEQ ID NO: 31103 - DNA, 246 bp, Homo sapiens
tataatttaacgtaactttttcattattcagacagggattatctacaccttaagtatattaagtgttttgttcaaggttacagtgctaaactagttactagagcctgctctagaattcacatctcttccttcttcgttctttgtggtggttttatactacactggataatggtgtcctgttaaaactccatcaatccaagaattgctcttttgctggaataccaggatggccctcttgctagaata

SEQ ID NO: 31104 - DNA, 472 bp, Homo sapiens
tcacttttcagattttttttcttcttttttaagagataggatctcgttctgtcacccaggctggagggcagtggtgcaatcatagctcactgcagcctctaactcctgggctcaagtgtcctcttgcctcagcctcccgaataactgggaccataggtgcaagccaccagctttttagattatttagtgctcagagtaatcagatacatcacccgtacgtgcggaagacagtgagtaaaccccaagataatgctgctacctcaataacagcttagtctatgacctaatacaacaccagctaacacttgctaagtattactccatgccagccactattcatgggttatcccatgtaatcctctcaatgacattgggggtgtgtgctatcttatctctatgtcataaatgaggctcaagtggggcccagacaggttcaggaacatgcttgctcaagtagccaccgctgccagag

SEQ ID NO: 31105 - DNA, 342 bp, Homo sapiens
actccaattctctttccccttccaagttacccccacctgaactacctgctcaacgaaagtttaccacaaagttattttcaattactacccaattacaatctccctgtggttgcacaatctgttttcataaaactaattaatgactttgatgcatcagcgaccccctgaaatgaagcattaattgcccagcctggatgctctttgccagcctgctaaaatggttccatttaaccccttggctcctgacactacccagttcaataccaccaggccccttttccctaatataactagatatgcctgatagtccccagcagaaagctccttacagtaaagtcgctg

SEQ ID NO: 31106 - DNA, 569 bp, Homo sapiens
ttacagggctaatatctttaatctttacacatttgacaatatccaataaaaagaacaccaaactacatcaagacaaaggagcaacagacatgggcctgcagaggacaaaagagaaaacaggagcactcaataaccaggaactcagggactttggaggcaacctgtgtgggttaaacatgcttttgaagatttttatcattatttctcattagaaatataaaaagtgggctgggcgccgtggctcacgcctgtaatcccagcactttgggaggccgaggcaagtggatcacgagatcaggagttcaagaccagcctggccaacatggtgaaaccccatctctactaaaaatccaaaaattagttgggtgtggtggagggcgcctgtaatcccagctactggggaggctgaggcaggaggattgcttgacctcaggaggcagaggttgcagtaagctgagatcacaccactgcattccagcctgggtgacagagtgagactctgtctcagaaaaaaagaaaagaaaagaaaagaaaagaaaagaaagaaagaaagaaagaaagaaagaaag

SEQ ID NO: 31107 - DNA, 412 bp, Homo sapiens
cttagagaatttaaagggtggtgctgataaacaagggaacttcataagtccaggctattagactagtaagatatgttttttttacatttataataccctaaacattagagaattaacatttgataagcccaaggatgttaataatttaaggagtactttgaatatactgaactttccctggatattaatgctttttctgtgttagtgcagaaaaactggagaacgccaggaaaggattttttcagcataattaaggaagaaaaacatgccctctgcagaatggcaaagcagtttggttatttaaactggagaagagcaaaggctggcatactcactgctttcagcgtctgcagggttgttttgtagtccctcagtgctccgtcacactgtgaatggagacatagcagaaaga

SEQ ID NO: 31108 - DNA, 273 bp, Homo sapiens
gacgctgccatcaaagggtgaaagtgaatgtaggtgatatgtaaatgaatgaacagggctatgacccactatagcattatttataagcaacttggtggcactgatttgtaattttccaacctctgccctagattaaacatctcccaatttttcacacatttttcctcatctggtgactatacaaagagccagtctccaaacctaattacaatggtttaagaccacctaggattttttttatcttaatgtagaccatagataatgaaataaaag

SEQ ID NO: 31109 - DNA, 462 bp, Homo sapiens
tgtgccattgggcaagttgtttctatttctggggtattgatttccccgtctcaaaataaatatcttttcctgctccgatcattctttccttttaagtattacctggctggtgaatgtttatattgaattctctttgtacaattcctttcaacaatattgcttggaattataaaaacttaataattgttttaaattgaaatgacaattgcaggttatccttgctttcaaaaagattttgtttctgaaatgtagcttgttaaaagtttggaaataaagcatcacatgaagaaataaagttatatcaagaaagatgcctaacacacacacacacacacacagtctcccccaccccatatatatatatatatattttttttttccagaggtatttcagagtaggtcacttatatcattgcctctacccctaagtacagtgtgtatttcttaataataaaaaaaata

SEQ ID NO: 31110 - DNA, 360 bp, Homo sapiens
ggaccaactagtagtttaatgcagagcggggaagcaactaagattttgaaagggaatgtcttgaatctgtggatcacttgggggagtattgccatctgaacaatatcaagtcttccaaatcattaacatgggatgttttgccaattatttaggtcttttaaaatttctttcaataatattgggcagttgttagtgtaaacattttgcacttctttgttaaatttattcataaatattttattctttttgatactgttaaaatagaattgttgtcttaattccattttcaacttgttcattgctagtgtatagaaatagaatttattgattttatcacatattgatatatcgatcttgtat

SEQ ID NO: 31111 - DNA, 490 bp, Homo sapiens
acaagggtggggtcagaggagccccgtggcgctgtggagggtgaccgggtgccagggtcccgggagctgcagggtttggggctgaggcgcaggatgaggccgacacaggggtcctggggcgcgggcggtccgagccgtcccctcaccgcccagcctcgtaggggcccgctgtgggccaactgcagcaggagctggggacacagccgtctcacacctgcctcctggtgcgtttctggggctcagggataggcgtcctcactcaggacacacaggactggtctggccgtggggtcaggccaggaggcatcccctttgcacctcctcacaccctgtggggaggggagggccctgggaacccatagacgcctgccccacagcagctgaggtcccgcagcagccagcagggctgggccacttgaggcctccggctctgatcgcccagagggcgcacggggtttggtgcagcctctgatgggcacgaggcggccgc

SEQ ID NO: 31112 - DNA, 328 bp, Homo sapiens
tgaaggaaagagttgatcttctcctagagttcaaattgctttcattgactccgaatgttccaccaaaaaatgaatgcaaaggaacctaagggcagatgagtattagaataagtccaccaaaagcaatgttctcaaagcaccagtgcttcaagctggcaacgcagcaaggtggctaagaaatgggttttgaactacacagacctggatgcaaatattgcctcttcaatcaacgagcaaaaaaaaagaaaaccttcagcaagtctctaatttcactaagctttagtttcttcattcattaaataaaaatcctagtcacacctatgactag

SEQ ID NO: 31113 - DNA, 351 bp, Homo sapiens
aagcattgactacgaaagaaaataatcttctatttgtaggattattggaagaaagaaatgtccttgctgaaagtattactgtagtgaaatatgctcacacttgattggccagagggggttacttgtgatacatgaatagatttagtgttttcttaacttctagaatgctattttccctaattttcgaatatcagtccacattttctgggtaaagggaggtgaggaagttgtttttgaatcaaattagattgaacaaacctaccatgggttattttctttaaaaatttattactttaaaataaaaactgaacgagagacataaataaaagtgatcatgtaaacaagtcgaat

SEQ ID NO: 31114 - DNA, 272 bp, Homo sapiens
aataaaaagattagcttaaaataattgaaatctgagaagttaattttgttgaccaacgaataggtttatgaagcatcccattttgaaatcagaaaatttatatttccaaactcgaatctgcctaaaaatgctacttttccaggcatggcagttgttctgattagattttgtataatgtacatgattagactatcagtttcatgtaggattctatataggtttataaattgtaaactctcagtatataataaattaaaaataagaaggctagt

SEQ ID NO: 31115 - DNA, 309 bp, Homo sapiens
ttttttttcttactctttcttcttcttcttttttttaagaaacgatcttgctcaggtgtgcaccatcacaaccagctaatttttaaattttttgtagagataggggtcttgctatcttgcccaggctggtcttgaactcctggtctcaagtaatcatcctgccatggcctgccaaagtgctgggatcataagtgtgagccaccacacgtaagcacattgcttttcttttgagtgaagccttttcattctgagttagtcgtctgttcacaaattttattcatttattaagtcattgatcaaatggtcgat

SEQ ID NO: 31116 - DNA, 655 bp, Homo sapiens
caaagagggtagccattgccggctcgaatacttgggtttagatcccgatcattgtccctcccactgtgctctcaggcagtagatgattgcctatttctttacctcttgtttttgcctaattagcattttagtgagctctctctactacctgattggtcgggtgtgagctaagttgcaagtcccatgtttaaaggtggaagcggtcaccttcccatctaggcttagggattcttagttggcctaggaaatccagctagtcctatctctcaaaacgagcctcaataaatttaagaaaattgaaattatatcaagcattctctcagaccacagtggaataaaactggaaatcaactccaaagggaaacttcaaaaccatgcaaatacatggaaattaaataacctgctcctgaatgagcactgggtcaaaaacaaaatcaagatggaaattaaaacattcttgaactgaatgacaataatggcacagcctatcaaaacctctgggatacagcaaaggcggtgctaagaggaaagttcacagccctaaacgcctacatcaaaaagtatgaaagagcacagacagacaatctaaggtcacacctcaaggaactagagaaacaacaaaccaaacccaaatccagcagaagaaaagaaataa

SEQ ID NO: 31117 - DNA, 742 bp, Homo sapiens
tctcctatctcagcctcctgaataactggggttacaggcacatgccaccatgcctggctaatttttgtattttcagtagagatgggatttcattatattggtcaggctggtcttaaactcctgacctcgggtgatcagcccgcctcggccttccaaagtgctgggattacaggcatgagccactgcacccagccgaatttatgtttcttatggtctagtctcagctaaattagactgagttggtaggagacaaccaacttcttaatgttggcatgaaattgtcattagcctctggatgctcatggtccagaagagatagaataggctgcttaaactagaggtaacataggagtgtggttgatactacatgacatactgcctgaaatactattcttcttctaacttgattaacatacataataatgtgttagtttttcattgttttggttttgttttgttttgagacggagttttgctcttgttgcccaggctggagtgcaatggcatgatcttggctcactgcaacctccgcctcctgggttcaagtgattccactgcctcagcctccctagtagctgggattacaggcatgagccaccgtgctcagcccagtttttcatattttttagataagtttaatataaaagcgatggctccagctactcgggaggctgaggtaggaggattgcttgtggctgggaattcaagacctctctaggcaacatagtgagacccacctcta

SEQ ID NO: 31118 - DNA, 562 bp, Homo sapiens
aacgagatgtggcacatcactgcatgtacctagcaagtacctagtaaaatgacataaactgatccctcaggtttttaagttgaaatagaaaggtttttattgtagcttttaaattctgtagttataaaggatgatattttcatatattgtattgaccatttaaaaataacattcctcaaatcactgttcctaaatcaggaatggaaggggatttcccctaacctgatgaagggtgtcctatatctgaattctttaaaaattttaaaaaataattttgatttattttttttagagatagagtctcgctctgttgcccaggctagaggtggagtgcagtggtgcaatcatagctcattgcagcctcaaactcctgggctcaagggatccttccgcctttgcctcttgagtagcctgatagagtatctataaaaggcttaaagcaagcatcatcttaaattggaaaatgttgaaagcatccctttaaaattaaaaaagtagaaaagtatgccaggttagaaccacttctattaaagattgtattgatggtcttagccagtgcagt

SEQ ID NO: 31119 - DNA, 504 bp, Homo sapiens
atggctggaagacacccgcagaaaccgcgggcactggagagcaagtgcagctttaatctccaggcgtgatttagatggaaagcagcctgaagaccagttaagagaaccgcgagcagagcgcgctggactagcaccaacagacgtgagttcgagaccgtcctgccccttaatcctgtgtgaccttggtccattttttaagtctgtgagcctcgcagtgttctcattcctgaaaagagcctgccccatctccggactgcagtgagaacaaaaggagactatgaacatgactttttgccacttttgaagccccacactgaggaaagattttcctagcacttgggagattttctttagcaccagctgccaagaatgctgggaaggagacagccccatcccagaaggaagacaccttaaatcagaactttatttttcctcctatgaaaatacaatctaatactggagaagtgtaaaaattaaggagtcattagaagccaaatgttgttg

SEQ ID NO: 31120 - DNA, 243 bp, Homo sapiens
cttcctagggctagcaggggtggctttctgttcagtccagtgaagaagctggtcctcagtgaggtcagcagcacgtggggtcctgagtctgcctagtgttgggtcgcgggtggtggaggggaggcagctgctttgggaggccagccacgggctgcagacaggcggctcacagaccagcggacagactgaggacagacaggaggcatcccttgggagcagccgggcccaccttgctggttgagt

SEQ ID NO: 31121 - DNA, 437 bp, Homo sapiens
  misc_feature (332)..(332): n is a, c, g, or t
  misc_feature (336)..(336): n is a, c, g, or t
  misc_feature (339)..(340): n is a, c, g, or t
cactgcattccagcctgggcaacagaacaagacttcgtctccataaaaaaagaatctgggatgactgcaggttctttcaggcaaagttcttttgcttgccatggtagaaatccacgtcaagtggaattagtgaaggagggacctcgttggaagtatatcaggtacgttgcagggcaggggcagttggctcagaaggaccgggtaccaaaccctggaagatggactccccaggaatcctcagaagcagcaacaccccacgtttggctgctgtcagctgcacttaagtttcctcagcctgctcgccccagcctcgggggcctgtggtgggaggngganggnnaggttggcacagccccttggctctgcagcacactgcctgtagtgcaccatgaattaatatttttaataaatcctgtaattatcttgtgaacagaaca

SEQ ID NO: 31122 - DNA, 302 bp, Homo sapiens
ctgattcaaggtttaccagaaatagcaaaacgctgccaaggggtgttccctcagagaggtcaagacgatcaacactgcctccaaatgttggttttctcctgcaccaggattgttctggttcagatttcccatgtgagctttaagaactgcatgttgtacatgacttgaacagaggagccaactcagctatggagcatctcctttttctacctatgcctttttctaccttacctaggatggcacccgatataacacaaagacaatgcaaatgagattcaacatgaatcactggtcatacctag

SEQ ID NO: 31123 - DNA, 333 bp, Homo sapiens
tttcttccagaagttttacattttctactcctaaatttaggtttatgatccatttgagttaatatttatgtatggtatgaggtcaaatgtgtgtgtgtgactgtccaatttttctagcagaattcgctggaaagggtatccttctactattgaatcctcttgacacctttgttgaagtcaattgaccacaagtgttaacagtttatttctggactctctcttgccttccattaatctatatgcctatccttgtgctaattccacactatctttgtttaatgtggctttatactaagttttgaaatcaggtggtataattcctccaactttgtt

SEQ ID NO: 31124 - DNA, 207 bp, Homo sapiens
ctactactactaaattcgcggcccgtcgacgaagttgctgctgacacactgggtgaagaatggaagggttatgtggtccgaatcagtggtgggaacgacaaataaggtttccccatgaagcagggtgtcttgacccatggccatgtccacctgctactgagtaaggggcattcctgttacagaccaaggagaactggagaaaggaag

SEQ ID NO: 31125 - DNA, 1083 bp, Homo sapiens
  misc_feature (344)..(345): n is a, c, g, or t
  misc_feature (368)..(369): n is a, c, g, or t
  misc_feature (465)..(466): n is a, c, g, or t
atggcccccacagagccctggagccccagcccggggtcagcgccctgggactactcggggttggacggcctggaggagctggagctgtgtccggccggggacctgccctacggctacgtctacatccccgcgctctacctggcggccttcgccgtgggcctgctgggcaacgcctttgtggtgtggctgctggccgggcggcggggcccgcggcggctggtggataccttcgtgctgcacctggcggcagctgacctgggcttcgtgctcacgctgccgctgtgggccgcggcggcggctaggcggccgtggccgttcggcgatggcctctgcaagctcagcannttcgcgctggcgggcacgcgctnngcgggcgcgctgctgctggcgggcatgagcgtggaccgctacctggccgtggtgaagctgctcgaggcgaggccactgcgcaccccgcgctgcgcnntggcctcgtgctgcggcgtctgggccgtggcgctgctggccggcctgccctccctggtctaccgggggttgcagcccctgcctgggggccaggacagccagtgcggcgaggagccctcccacgccttccagggcctcagcttgctgctgctgctgctgaccttcgtgctgcccctggtcgtcaccctcttctgctactgccgcatctcgcgccgcctgcgacggccgccgcacgtgggtcgggcccggaggaactcgctgcgcatcatcttcgccatcgagagcacgtttgtgggctcctggctgcccttcagcgccctgcgggccgtcttccacctggcgcgtctgggggcgctgccgctgccgtgccccctgctgctggcgctgcgctggggcctcaccattgccacctgcctggccttcgtcaacagctgcgccaacccgctcatctacctcctgctggaccgctcattccgagcccgggcgctggacggggcctgcgggcgcaccggccgcctggcgcgaaggatcagctcagcctcctcgctctccagggacgacagttccgtgttccgttgccgggcccaggccgcgaacactgcctcggcctcctggtag

SEQ ID NO: 31126 - DNA, 748 bp, Homo sapiens
caacctgtggatcaagagatcccctcgtgagcccacgccaccaggaccttgggtcccaagtacatagctatgcagactctaggcagcaggctggagactgcttaagatgactgagttcccggagcagaagggctgccgccatcactgcagctccagtcagcaatttcccctgcaggtaccagggagactgggcggtttggaccaggaggaattccccacagcacagcggcttatggcagatcttggccagattgcttctttaaggtgggaaccagatccaaccctccttcaccagactgggcctccctgtgggaatttcagcaactccagccaggggtttacggacagaactctgatctccctgggatggagccctttgaggggaggggtggccacgttctccatggttcagtggacttagtctttcctgcctggtggctctgaagagtccaggcagtctggatgaagggaatgtgcccctaacgcagtgcacccactctgccaagggacagccagagtgcttcattaagcgggtccctgatactgtgcctcctgactgggtgagaccccacaacagaggttattagaaaccttgtaaaagagcattcccgccggcatcaggtcagtgtccctctgggatggagatcccagaaaaagtagcaggcagccatctttgctgttctgtagcctccactggggacacctccaggtgtgggagggacccaggcaaatagggtctggaatgaac

SEQ ID NO: 31127 - DNA, 447 bp, Homo sapiens
aaaagcccccaagtagtcctggcattcaagctcttggtagatcagagtcccttcagctcttctgtctccatgctcttgttctaacaagttcaaaagacattgttaccgtggatataaatttagttagcatattgaaaaataaaaaattattttcttgtatcctccttacattcctgaatgtttccttatcctattctatgtgcttgttcaatcacctaccactcattaatttaatccaatctttttttttctagattagaaattcttaaaagttaagtgtaccttagaattatctggaggttgtgttaaaacacacatttctggctcttcaaccagggtttctgatttgcagctctggagtgaggcctgaagatgtacatttctagtaagctgctagacgatgctggttcagggactatactttgaaaactactattttaggatatt

SEQ ID NO: 31128 - DNA, 456 bp, Homo sapiens
aattgcaattatggcctgcgctttaaagtactgcggcaatgttatatttattgaatttgataactgtgcagtggttatctttatattagagaatattcttcttaggaaatttcgactttaaatattgaggtgtaaagggcgtgatatatgcaacttacccacaagcggttcagaataatacatttatttatctatgtttatatagatgtgtagtacatatacacataaacatatccatgagagtgagaagagagagaatgaaagttaatgaaaaatgttaaaaattgatgaatctaggtaataggcaggcattctctatactgttcttgtaacttttcactaagtttgaaattatttttaaaatgcaaagttaaagttgtaagttaaaaagtaaaataaaaacagtttttctaaatggttgcaaatatgagtatacttgctaaagacaagctttat

SEQ ID NO: 31129 - DNA, 484 bp, Homo sapiens
tgccatgggtggggcagagcgtctgggatgcgctgggagcctaggatccccgacagttttgcagaacactgaaatctatggactctaaaatggacttcatttaaagaaacccacggaccattaatggacaaaaacatgagtcaatatgtattgtggcattcaaatcctagcactctgggagagcatcaagtaccacgtttttgaagaccatggcctatcatcattatgcattcaagatttgagtttgaataacctcatcaagacttagatcttcttcagaagcttcaagtctcatctgcattaaagctctccattgaaccctctcacaaaagtacaagcttaaaggggctaaaatccattaatacattccattttatatcccttcctctgacttctcttcaatttccttggcctctagggtccttcatattgcttacgttcctttagactagagccaaggagacagtgctttccaaaaaaaaaa

SEQ ID NO: 31130 - DNA, 553 bp, Homo sapiens
attctgttgcaattttcagtgaagggtattaatcaaagagataagccaatgaacatattcagccattttgtctactgtaccttttcaaaaaaatttttttccttttctttgtttttgattttctccttttgttctttcagcatggtatctagtaatctgattaattactgacccaaaagtagtttttaatttcccttaaaaaaattattagacttgtagtagaatttttttgtgttttgttttgttttcaagcatcaagtaccacgtttttgaagaccatggcctatcatcattatgcattcaagatttgagtttgaataacctcatcaagacttagatcttcttcagaagcttcaagtctcatctgcattaaagctctccattgaaccctctcacaaaagtacaagcttaaaggggctaaaatccattaatacattccattttatatcccttcctctgacttctcttcaatttccttggcctctagggtccttcatattgcttacgttcctttagactagagccaaggagacagtgctttccaaaaaaaaaa

SEQ ID NO: 31131 - DNA, 343 bp, Homo sapiens
caaaagatttaagtcttccttcctcgtgattgtactgctttattgcactgcttgcagactgcagtagaaaataagcttttaagactttctagattttcaggctttctactaagctgttgtagcttctccatcccacatctgggtttgctcactttatttctatgtgccaaatcatgattgagactcgttgagacacacagtagaccacaggttgccatatttagcagagcagggaaagaactctggagagtttgcctttttgattagggagaaacgctgtgggaggtatttgttgagcagctactctgggcaggaccctgagaactatcaatttttggatgcg

SEQ ID NO: 31132 - DNA, 316 bp, Homo sapiens
tgattgacattccttctatatgacatagctataaatgtgcatctctaaattttgcatcttagttgaagggaaatctggagatcattcagtgattgttcgagaataaattgacctttacaatcttacttgttaggtatctaagccaaatgttacaaccattatcccttccactaaacttttgtggaccaggagttccaatgacgtacacattcacagttatctctccaccccaactgaagcttgataactcttggagctgccatcattctaagtagataataaaactttggggatataaatagcccttaatcgattt

SEQ ID NO: 31133 - DNA, 901 bp, Homo sapiens
cctgcagacttgctgatgtgttgatcctgcagccagaagcctattaaggctagaaatgagtgtgacggatgcaaatgctgtggtggccatacttagtgccccctttcccagagccgcttgtgctgagtctagctcattaacttgctgcaaacccctaaggggcaaagaagggccgggtaaggcagtggtgggctgccaggtgggtggccaggcaggatgagggtggcaggagcctgccacttcctcggtttggtgcgatccgccaggacggagaaaggagagggaaggtatggacccccacagtgccctatcaccccaataattgaggaaatggcacttcctagtatcggcagcatgccaggcactgcgtggatgtgtaagaccctatagttaacataacactgattatttccatcccaggctcagaaagatggatttggtccaggttgcagagccaggcttctgaactctctcctgtgccctgagcctcttgtcaggaggagctggagcctggggttgggccttgggctcgcattccggctccgcttgccatgtgacctcctgcctttagtttctactcatacatcgttaggcttcatagtggaggacactgaaaacccttagcaaactgtaaagttccagagaattaaccttccctgacccagtgagctgggtttgaagcaggaatgtcagagcatggcaggtgtggagaaacctcgaattcagccctgccctgcccgggcctcgccagagctccctctccagctcctcttgcctccctgccccaggatccccttcccggccttgggggtccaaggcggccttaaaagaaggactactttctccgaaggggacttgaagttgaggccgctcagcaactgcagaggtcgggcctccggga

SEQ ID NO: 31134 - DNA, 541 bp, Homo sapiens
cctgcagacttgctgatgtgttgatcctgcagccagaagcctattaaggctagaaatgagtgtgacggatgcaaatgctgtggtggccatacttagtgccccctttcccagagccgcttgtgctgagtctagctcattaacttgctgcaaacccctaaggggcaaagaagggccgggtaaggcagtggtgggctgccaggtgggtggccaggcaggatgagggtggcaggagcctgccacttcctcggtttggtgcgatccgccaggacggagaaaggagagggaaggtatggacccccacagtgccctatcaccccaataattgaggaaatggcacttcctagtatcggcagcatgccaggcactgcgtggatgtgtaagaccctatagttaacataacactgattatttccatcccaggctcagaaagatggatttggtccaggttgcagagccaggcttctgaactctctccctgtcgggcttttcgggggttgcagagccaggcttctgaactctctccctgtcgggctagtcgggg

SEQ ID NO: 31135 - DNA, 358 bp, Homo sapiens
aacatcatttcaaaggatacggggaaaagagatgtcacatgaacacgtcttagaatttacactgtaaatcaaacaatgttgctgcaaaggcatgtaagttaatatagaaacaatggaagaatgtaaagaaaactcagagacagggaagaaagccaggataggctccaagatcagctggatgagatcacaacatgtgaccctcacagatgatagatcaagaaaatgggaagagcttcaaagccctgaaaccatataaaggagagtcacccaacaactaaaagcacccatcctaaactattatgtgaacaagaaacaaacctctattaatatatttgaattattaaatattttgagtcta

SEQ ID NO: 31136 - DNA, 574 bp, Homo sapiens
aattaactgcatcagttatattaataccaaggataggaagcctacatacaccggtttagaggggctattacttaagcgactaaaggctattgcctaagaaatctggttaggaggaacagctgaaaactaggaatctttctaaagccgaggttgcacatgggagtcacctggggagcttgtacaattccctccacctaagctgcaccctgggctagcgaaatcccagtctctggggccggggtccgttttccttgaagttctgcagattccagtagacgatcagtgttgagatttagtaccctaacaggaatgtttttttaataaagcaaacaaacttttaaaggcggcacactcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctactcgggaggctgaggcaggagaatggcgtgaacccgggaggcggagcttgcagtgagccgagatcc

SEQ ID NO: 31137 - DNA, 3132 bp, Homo sapiens
agcggagtcggagccgggcttgcccgggcatgtgggagctgccggctttccggacgccacgtgcagaccggaagagacacgcggggcttcaggctgctgccccattggaagattactccccaggcttcccttgccccaagcagtgagctgactggaatggtaccccgggaggcccctgagtctgctcagtgcctgtgcccttccctcaccatcccaaatgccaaggatgtgcttcggaagaggcacaagagaaggagccgacagcaccagcggttcatggcccggaaggccttgctgcaggagcaggggctgctgagcatgcctccagaaccagggtcctccccactgcccacccctttcggggcagcgacagcaactgaagctgccagcagtgggaagcagtgtctgagggctggatctggcagtgccccatgcagcagaaggcctgctcccgggaaagcctcagggcccttgcccagcaagtgtgtggctatcgactgtgagatggtgggcacgggaccccgagggcgggtaagcgagctggcccgctgttccattgtgagctaccatggcgatgtcctctatgacaagtacatcaggcctgagatgcccatcgctgactaccgtacccgctggagtggcatcactcggcagcacatgcgcaaggctgtccccttccaggtggcccagaaagagatccttaagctcctgaagggcaaggtggtggtggggcacgcgctgcacaacgacttccaggcgctcaagtatgtccaccctcggagccagacccgggataccacctatgtcccaaacttcctcagcgagcccggcctccacacccgggcccgggtctctctaaaggacctggccctgcagctgctgcacaagaagatccaggtgggccagcacgggcactcatcagtagaagatgccacgacagccatggagctctaccggctggtggaggtgcagtgggaacagcaggaggcccgcagcctctggacctgccccgaggacagagaacctgacagcagcacagacatggaacagtacatggaggaccagtactggcccgatgacctggcccacggcagcagaggaggagccagggaggcacaggacagaaggaattgagaagggggcggggctccctggctgggcttccggtgtggccggtaggaagtgggggccaggagagcagcgggcactccttcctgggcagggtggggcaggatgcagtgagccagccccagggccagaggagttggggtcatctgttaccttgacaccctctgcacacagcatagccctctctctctccagggctgttggttctttctcctgactcctgtggttttgctaatggcactttacagactccatggagatgtcaggtggaccatcttctagggcccagcaggagtagggaatgtgccaacagactgcccaggttgccgtggccttccccaccccccagatctcctgagtcatcatgctgtgctaatgaaagggatcatatcatcctctctggggatggtgggtgggggtgtcaatatcctggagctcccttaccccaactcaatgacttgggggtaaagttctcttccttttgttgcctacctcttcctccactcatttgggttcagaataaacatgccctgaagttaaagaggagttaagtcctaaaggaggcatttcttccccacctccctgacctggaactctggctacagccattgtaggaactccgtgcctggcctgtcagctccctgctaggctacagtggaatagcagagcccacaggcttctcgtggggagttggctccttaacatttcttggcaacagaaagccccaggcacagctcagggaggagggaaggcaggtaagctttggacgagaactggcatatttattttgacccaaatcagggatttccccagtccacccagtactgggctcttaagcaaaagtctgagaaacaagacagtggtttgaattctggggcctttgtgtaggattgtgcctgacctttatttatttattaacagcagggccactcgtctagggcagtggagtctgcgtgtctcctggggctggggcagggcattggcagttacgcagtggccctgaacctggtctggtgcccccgaacctggtctgatgccccctcagctctttgacaatcactgtggctgttgggttttctcctatttctaaaaatgttctcttctttcctaagtgacagttttgaagtattggataaccaagagctcaggtcacacagaccttggagccccatctttgcttgcagcttagctttgagatactaagcaagcgagggacttcactcttgagcctgttttttcctcatctgtaaagtggggatagtggtacggcctacctcatagggttgtaatgagcactaaatgtgaagtgcttggcacagtgcctggcacatggtgagccacagctactgtgagtttctgtttatcccccttttttttttttaagcccattgtttattctttgagaatttgttgtaacttcttcaggataacacctgagtccacaggctgagcagctgtggcccagacagaactgctccggcttggctgttccagcaggtggggcgctggcctcggtgagggcacagcagcaaggttcacggatatccgtgtgtcttgtctgtggccaccaggcacaggtttggcttccggtcagtgtcccgacactgtgcgggaggtgacaacagagcaaagcagcgcaggggtcagggaggtggagacactgctgaaatcacactaccccaccctcagctgaagccccacgttccacaaacttggggtcatagattgtccagtcactggctccctccctgtcagcacagcacagaggaaggggctaactgaatcttttaccacttctggcctggctccagaactttgttctagattccttaaaagtcggtagctgatgtcaaactcaattgagcagtagctttgatcccttggtctgggggtcgaaggaagatggcgctgttatcagcggggaaatgtactatttaagatcagctttgttgtaaaaccatttgttctagaataaaactcaattggaaacgtgaaaaaaaaaac

SEQ ID NO: 31138 - DNA, 3391 bp, Homo sapiens
cgcaggtccccgcgcgttgtttccgccccggcctgcggcggggacgcctgaactgggctgaccctgccctaccggcccgcagaaaagcaggccgggcgccgcctgtctccagccctcgctctgctcgggggtccagggccagagggggcggcgctggtcgttgggactcggcccagctgccgcggccagcaagtgaccaacgcccgagtccttcccggtgagatcaggcctcccacgcgtcacgcctgggagaacgccagccggcggggaggtcgtgccaggatagcagactttagttgttgtcgttgttccgtggactttttagcagcacaggggaccttatcgagccaggctgctgccccattggaagattactccccaggcttcccttgccccaagcagtgagctgactggaatggtaccccgggaggcccctgagtctgctcagtgcctgtgcccttccctcaccatcccaaatgccaaggatgtgcttcggaagaggcacaagagaaggagccgacagcaccagcggttcatggcccggaaggccttgctgcaggagcaggggctgctgagcatgcctccagaaccagggtcctccccactgcccacccctttcggggcagcgacagcaactgaagctgccagcagtgggaagcagtgtctgagggctggatctggcagtgccccatgcagcagaaggcctgctcccgggaaagcctcagggcccttgcccagcaagtgtgtggctatcgactgtgagatggtgggcacgggaccccgagggcgggtaagcgagctggcccgctgttccattgtgagctaccatggcgatgtcctctatgacaagtacatcaggcctgagatgcccatcgctgactaccgtacccgctggagtggcatcactcggcagcacatgcgcaaggctgtccccttccaggtggcccagaaagagatccttaagctcctgaagggcaaggtggtggtggggcacgcgctgcacaacgacttccaggcgctcaagtatgtccaccctcggagccagacccgggataccacctatgtcccaaacttcctcagcgagcccggcctccacacccgggcccgggtctctctaaaggacctggccctgcagctgctgcacaagaagatccaggtgggccagcacgggcactcatcagtagaagatgccacgacagccatggagctctaccggctggtggaggtgcagtgggaacagcaggaggcccgcagcctctggacctgccccgaggacagagaacctgacagcagcacagacatggaacagtacatggaggaccagtactggcccgatgacctggcccacggcagcagaggaggagccagggaggcacaggacagaaggaattgagaagggggcggggctccctggctgggcttccggtgtggccggtaggaagtgggggccaggagagcagcgggcactccttcctgggcagggtggggcaggatgcagtgagccagccccagggccagaggagttggggtcatctgttaccttgacaccctctgcacacagcatagccctctctctctccagggctgttggttctttctcctgactcctgtggttttgctaatggcactttacagactccatggagatgtcaggtggaccatcttctagggcccagcaggagtagggaatgtgccaacagactgcccaggttgccgtggccttccccaccccccagatctcctgagtcatcatgctgtgctaatgaaagggatcatatcatcctctctggggatggtgggtgggggtgtcaatatcctggagctcccttaccccaactcaatgacttgggggtaaagttctcttccttttgttgcctacctcttcctccactcatttgggttcagaataaacatgccctgaagttaaagaggagttaagtcctaaaggaggcatttcttccccacctccctgacctggaactctggctacagccattgtaggaactccgtgcctggcctgtcagctccctgctaggctacagtggaatagcagagcccacaggcttctcgtggggagttggctccttaacatttcttggcaacagaaagccccaggcacagctcagggaggagggaaggcaggtaagctttggacgagaactggcatatttattttgacccaaatcagggatttccccagtccacccagtactgggctcttaagcaaaagtctgagaaacaagacagtggtttgaattctggggcctttgtgtaggattgtgcctgacctttatttatttattaacagcagggccactcgtctagggcagtggagtctgcgtgtctcctggggctggggcagggcattggcagttacgcagtggccctgaacctggtctggtgcccccgaacctggtctgatgccccctcagctctttgacaatcactgtggctgttgggttttctcctatttctaaaaatgttctcttctttcctaagtgacagttttgaagtattggataaccaagagctcaggtcacacagaccttggagccccatctttgcttgcagcttagctttgagatactaagcaagcgagggacttcactcttgagcctgttttttcctcatctgtaaagtggggatagtggtacggcctacctcatagggttgtaatgagcactaaatgtgaagtgcttggcacagtgcctggcacatggtgagccacagctactgtgagtttctgtttatcccccttttttttttttaagcccattgtttattctttgagaatttgttgtaacttcttcaggataacacctgagtccacaggctgagcagctgtggcccagacagaactgctccggcttggctgttccagcaggtggggcgctggcctcggtgagggcacagcagcaaggttcacggatatccgtgtgtcttgtctgtggccaccaggcacaggtttggcttccggtcagtgtcccgacactgtgcgggaggtgacaacagagcaaagcagcgcaggggtcagggaggtggagacactgctgaaatcacactaccccaccctcagctgaagccccacgttccacaaacttggggtcatagattgtccagtcactggctccctccctgtcagcacagcacagaggaaggggctaactgaatcttttaccacttctggcctggctccagaactttgttctagattccttaaaagtcggtagctgatgtcaaactcaattgagcagtagctttgatcccttggtctgggggtcgaaggaagatggcgctgttatcagcggggaaatgtactatttaagatcagctttgttgtaaaaccatttgttctagaataaaactcaattggaaacgtgaaaaaaaaaac

SEQ ID NO: 31139 - DNA, 3061 bp, Homo sapiens
aggccgggtggtgcgatgaccgctgctgccccattggaagattactccccaggcttcccttgccccaagcagtgagctgactggaatggtaccccgggaggcccctgagtctgctcagtgcctgtgcccttccctcaccatcccaaatgccaaggatgtgcttcggaagaggcacaagagaaggagccgacagcaccagcggttcatggcccggaaggccttgctgcaggagcaggggctgctgagcatgcctccagaaccagggtcctccccactgcccacccctttcggggcagcgacagcaactgaagctgccagcagtgggaagcagtgtctgagggctggatctggcagtgccccatgcagcagaaggcctgctcccgggaaagcctcagggcccttgcccagcaagtgtgtggctatcgactgtgagatggtgggcacgggaccccgagggcgggtaagcgagctggcccgctgttccattgtgagctaccatggcgatgtcctctatgacaagtacatcaggcctgagatgcccatcgctgactaccgtacccgctggagtggcatcactcggcagcacatgcgcaaggctgtccccttccaggtggcccagaaagagatccttaagctcctgaagggcaaggtggtggtggggcacgcgctgcacaacgacttccaggcgctcaagtatgtccaccctcggagccagacccgggataccacctatgtcccaaacttcctcagcgagcccggcctccacacccgggcccgggtctctctaaaggacctggccctgcagctgctgcacaagaagatccaggtgggccagcacgggcactcatcagtagaagatgccacgacagccatggagctctaccggctggtggaggtgcagtgggaacagcaggaggcccgcagcctctggacctgccccgaggacagagaacctgacagcagcacagacatggaacagtacatggaggaccagtactggcccgatgacctggcccacggcagcagaggaggagccagggaggcacaggacagaaggaattgagaagggggcggggctccctggctgggcttccggtgtggccggtaggaagtgggggccaggagagcagcgggcactccttcctgggcagggtggggcaggatgcagtgagccagccccagggccagaggagttggggtcatctgttaccttgacaccctctgcacacagcatagccctctctctctccagggctgttggttctttctcctgactcctgtggttttgctaatggcactttacagactccatggagatgtcaggtggaccatcttctagggcccagcaggagtagggaatgtgccaacagactgcccaggttgccgtggccttccccaccccccagatctcctgagtcatcatgctgtgctaatgaaagggatcatatcatcctctctggggatggtgggtgggggtgtcaatatcctggagctcccttaccccaactcaatgacttgggggtaaagttctcttccttttgttgcctacctcttcctccactcatttgggttcagaataaacatgccctgaagttaaagaggagttaagtcctaaaggaggcatttcttccccacctccctgacctggaactctggctacagccattgtaggaactccgtgcctggcctgtcagctccctgctaggctacagtggaatagcagagcccacaggcttctcgtggggagttggctccttaacatttcttggcaacagaaagccccaggcacagctcagggaggagggaaggcaggtaagctttggacgagaactggcatatttattttgacccaaatcagggatttccccagtccacccagtactgggctcttaagcaaaagtctgagaaacaagacagtggtttgaattctggggcctttgtgtaggattgtgcctgacctttatttatttattaacagcagggccactcgtctagggcagtggagtctgcgtgtctcctggggctggggcagggcattggcagttacgcagtggccctgaacctggtctggtgcccccgaacctggtctgatgccccctcagctctttgacaatcactgtggctgttgggttttctcctatttctaaaaatgttctcttctttcctaagtgacagttttgaagtattggataaccaagagctcaggtcacacagaccttggagccccatctttgcttgcagcttagctttgagatactaagcaagcgagggacttcactcttgagcctgttttttcctcatctgtaaagtggggatagtggtacggcctacctcatagggttgtaatgagcactaaatgtgaagtgcttggcacagtgcctggcacatggtgagccacagctactgtgagtttctgtttatcccccttttttttttttaagcccattgtttattctttgagaatttgttgtaacttcttcaggataacacctgagtccacaggctgagcagctgtggcccagacagaactgctccggcttggctgttccagcaggtggggcgctggcctcggtgagggcacagcagcaaggttcacggatatccgtgtgtcttgtctgtggccaccaggcacaggtttggcttccggtcagtgtcccgacactgtgcgggaggtgacaacagagcaaagcagcgcaggggtcagggaggtggagacactgctgaaatcacactaccccaccctcagctgaagccccacgttccacaaacttggggtcatagattgtccagtcactggctccctccctgtcagcacagcacagaggaaggggctaactgaatcttttaccacttctggcctggctccagaactttgttctagattccttaaaagtcggtagctgatgtcaaactcaattgagcagtagctttgatcccttggtctgggggtcgaaggaagatggcgctgttatcagcggggaaatgtactatttaagatcagctttgttgtaaaaccatttgttctagaataaaactcaattggaaacgtgaaaaaaaaaac

SEQ ID NO: 31140 - DNA, 2620 bp, Homo sapiens
cgcaggtccccgcgcgttgtttccgccccggcctgcggcggggacgcctgaactgggctgaccctgccctaccggcccgcagaaaagcaggccgggcgccgcctgtctccagccctcgctctgctcgggggtccagggccagagggggcggcgctggtcgttgggactcggcccagctgccgcggccagcaagtgaccaacgcccgagtccttcccggctgctgccccattggaagattactccccaggcttcccttgccccaagcagtgagctgactggaatggtacctatgtcccaaacttcctcagcgagcccggcctccacacccgggcccgggtctctctaaaggacctggccctgcagctgctgcacaagaagatccaggtgggccagcacgggcactcatcagtagaagatgccacgacagccatggagctctaccggctggtggaggtgcagtgggaacagcaggaggcccgcagcctctggacctgccccgaggacagagaacctgacagcagcacagacatggaacagtacatggaggaccagtactggcccgatgacctggcccacggcagcagaggaggagccagggaggcacaggacagaaggaattgagaagggggcggggctccctggctgggcttccggtgtggccggtaggaagtgggggccaggagagcagcgggcactccttcctgggcagggtggggcaggatgcagtgagccagccccagggccagaggagttggggtcatctgttaccttgacaccctctgcacacagcatagccctctctctctccagggctgttggttctttctcctgactcctgtggttttgctaatggcactttacagactccatggagatgtcaggtggaccatcttctagggcccagcaggagtagggaatgtgccaacagactgcccaggttgccgtggccttccccaccccccagatctcctgagtcatcatgctgtgctaatgaaagggatcatatcatcctctctggggatggtgggtgggggtgtcaatatcctggagctcccttaccccaactcaatgacttgggggtaaagttctcttccttttgttgcctacctcttcctccactcatttgggttcagaataaacatgccctgaagttaaagaggagttaagtcctaaaggaggcatttcttccccacctccctgacctggaactctggctacagccattgtaggaactccgtgcctggcctgtcagctccctgctaggctacagtggaatagcagagcccacaggcttctcgtggggagttggctccttaacatttcttggcaacagaaagccccaggcacagctcagggaggagggaaggcaggtaagctttggacgagaactggcatatttattttgacccaaatcagggatttccccagtccacccagtactgggctcttaagcaaaagtctgagaaacaagacagtggtttgaattctggggcctttgtgtaggattgtgcctgacctttatttatttattaacagcagggccactcgtctagggcagtggagtctgcgtgtctcctggggctggggcagggcattggcagttacgcagtggccctgaacctggtctggtgcccccgaacctggtctgatgccccctcagctctttgacaatcactgtggctgttgggttttctcctatttctaaaaatgttctcttctttcctaagtgacagttttgaagtattggataaccaagagctcaggtcacacagaccttggagccccatctttgcttgcagcttagctttgagatactaagcaagcgagggacttcactcttgagcctgttttttcctcatctgtaaagtggggatagtggtacggcctacctcatagggttgtaatgagcactaaatgtgaagtgcttggcacagtgcctggcacatggtgagccacagctactgtgagtttctgtttatcccccttttttttttttaagcccattgtttattctttgagaatttgttgtaacttcttcaggataacacctgagtccacaggctgagcagctgtggcccagacagaactgctccggcttggctgttccagcaggtggggcgctggcctcggtgagggcacagcagcaaggttcacggatatccgtgtgtcttgtctgtggccaccaggcacaggtttggcttccggtcagtgtcccgacactgtgcgggaggtgacaacagagcaaagcagcgcaggggtcagggaggtggagacactgctgaaatcacactaccccaccctcagctgaagccccacgttccacaaacttggggtcatagattgtccagtcactggctccctccctgtcagcacagcacagaggaaggggctaactgaatcttttaccacttctggcctggctccagaactttgttctagattccttaaaagtcggtagctgatgtcaaactcaattgagcagtagctttgatcccttggtctgggggtcgaaggaagatggcgctgttatcagcggggaaatgtactatttaagatcagctttgttgtaaaaccatttgttctagaataaaactcaattggaaacgtgaaaaaaaaaac

SEQ ID NO: 31141 - DNA, 2247 bp, Homo sapiens
agcggagtcggagccgggcttgcccgggcatgtgggagctgccggctttccggacgccacgtgcagaccggaagagacacgcggggcttcaggctgctgccccattggaagattactccccaggcttcccttgccccaagcagtgagctgactggaatggtaccccgggaggcccctgagtctgctcagtgcctgtgcccttccctcaccatcccaaatgccaaggatgtgcttcggaagaggcacaagagaaggagccgacagcaccagcggttcatggcccggaaggccttgctgcaggagcaggggctgctgagcatgcctccagaaccagggtcctccccactgcccacccctttcggggcagcgacagcaactgaagctgccagcagtgggaagcagtgtctgagggctggatctggcagtgccccatgcagcagaaggcctgctcccgggaaagcctcagggcccttgcccagcaagtgtgtggctatcgactgtgagatggtgggcacgggaccccgagggcgggtaagcgagctggcccgctgttccattgtgagctaccatggcgatgtcctctatgacaagtacatcaggcctgagatgcccatcgctgactaccgtacccgctggagtggcatcactcggcagcacatgcgcaaggctgtccccttccaggtggcccagaaagagatccttaagctcctgaagggcaaggtggtggtggggcacgcgctgcacaacgacttccaggcgctcaagtatgtccaccctcggagccagacccgggataccacctatgtcccaaacttcctcagcgagcccggcctccacacccgggcccgggtctctctaaaggacctggccctgcagctgctgcacaagaagatccaggtgggccagcacgggcactcatcagtagaagatgccacgacagccatggagctctaccggctggtggaggtgcagtgggaacagcaggaggcccgcagcctctggacctgccccgaggacagagaacctgacagcagcacagacatggaacagtacatggaggaccagtactgggctcttaagcaaaagtctgagaaacaagacagtggtttgaattctggggcctttgtgtaggattgtgcctgacctttatttatttattaacagcagggccactcgtctagggcagtggagtctgcgtgtctcctggggctggggcagggcattggcagttacgcagtggccctgaacctggtctggtgcccccgaacctggtctgatgccccctcagctctttgacaatcactgtggctgttgggttttctcctatttctaaaaatgttctcttctttcctaagtgacagttttgaagtattggataaccaagagctcaggtcacacagaccttggagccccatctttgcttgcagcttagctttgagatactaagcaagcgagggacttcactcttgagcctgttttttcctcatctgtaaagtggggatagtggtacggcctacctcatagggttgtaatgagcactaaatgtgaagtgcttggcacagtgcctggcacatggtgagccacagctactgtgagtttctgtttatcccccttttttttttttaagcccattgtttattctttgagaatttgttgtaacttcttcaggataacacctgagtccacaggctgagcagctgtggcccagacagaactgctccggcttggctgttccagcaggtggggcgctggcctcggtgagggcacagcagcaaggttcacggatatccgtgtgtcttgtctgtggccaccaggcacaggtttggcttccggtcagtgtcccgacactgtgcgggaggtgacaacagagcaaagcagcgcaggggtcagggaggtggagacactgctgaaatcacactaccccaccctcagctgaagccccacgttccacaaacttggggtcatagattgtccagtcactggctccctccctgtcagcacagcacagaggaaggggctaactgaatcttttaccacttctggcctggctccagaactttgttctagattccttaaaagtcggtagctgatgtcaaactcaattgagcagtagctttgatcccttggtctgggggtcgaaggaagatggcgctgttatcagcggggaaatgtactatttaagatcagctttgttgtaaaaccatttgttctagaataaaactcaattggaaacgtgaaaaaaaaaac

SEQ ID NO: 31142 - DNA, 1527 bp, Homo sapiens
aaaataggataggtacgagatcgggtgtgactcaggccgagaataaacatgccctgaagttaaagaggagttaagtcctaaaggaggcatttcttccccacctccctgacctggaactctggctacagccattgtaggaactccgtgcctggcctgtcagctccctgctaggctacagtggaatagcagagcccacaggcttctcgtggggagttggctccttaacatttcttggcaacagaaagccccaggcacagctcagggaggagggaaggcaggtaagctttggacgagaactggcatatttattttgacccaaatcagggatttccccagtccacccagtactgggctcttaagcaaaagtctgagaaacaagacagtggtttgaattctggggcctttgtgtaggattgtgcctgacctttatttatttattaacagcagggccactcgtctagggcagtggagtctgcgtgtctcctggggctggggcagggcattggcagttacgcagtggccctgaacctggtctggtgcccccgaacctggtctgatgccccctcagctctttgacaatcactgtggctgttgggttttctcctatttctaaaaatgttctcttctttcctaagtgacagttttgaagtattggataaccaagagctcaggtcacacagaccttggagccccatctttgcttgcagcttagctttgagatactaagcaagcgagggacttcactcttgagcctgttttttcctcatctgtaaagtggggatagtggtacggcctacctcatagggttgtaatgagcactaaatgtgaagtgcttggcacagtgcctggcacatggtgagccacagctactgtgagtttctgtttatcccccttttttttttttaagcccattgtttattctttgagaatttgttgtaacttcttcaggataacacctgagtccacaggctgagcagctgtggcccagacagaactgctccggcttggctgttccagcaggtggggcgctggcctcggtgagggcacagcagcaaggttcacggatatccgtgtgtcttgtctgtggccaccaggcacaggtttggcttccggtcagtgtcccgacactgtgcgggaggtgacaacagagcaaagcagcgcaggggtcagggaggtggagacactgctgaaatcacactaccccaccctcagctgaagccccacgttccacaaacttggggtcatagattgtccagtcactggctccctccctgtcagcacagcacagaggaaggggctaactgaatcttttaccacttctggcctggctccagaactttgttctagattccttaaaagtcggtagctgatgtcaaactcaattgagcagtagctttgatcccttggtctgggggtcgaaggaagatggcgctgttatcagcggggaaatgtactatttaagatcagctttgttgtaaaaccatttgttctagaataaaactcaattggaaacgtgaaaaaaaaaac
